United States Patent 11,446,398 (REGULATED BIOCIRCUIT SYSTEMS) - sequence listing, part 11

SEQ ID NO: 45463 - protein, 35 aa, Homo sapiens
  Payload ID: 9262
  Gene Symbol: LRRCC1
  Gene Name: leucine rich repeat and coiled-coil centrosomal protein 1
  ENSP ID: ENSP00000428506
MEAAAAVVAAEAEVENEDGDSSCGDVCFMDKGLQR

SEQ ID NO: 45464 - protein, 36 aa, Homo sapiens
  Payload ID: 9262
  Gene Symbol: LRRCC1
  Gene Name: leucine rich repeat and coiled-coil centrosomal protein 1
  ENSP ID: ENSP00000428794
MEAAAAVVAAEAEVENEDGDSSCGDVCFMDKGLQRT

SEQ ID NO: 45465 - protein, 36 aa, Homo sapiens; identical to SEQ ID NO: 45464
  Payload ID: 9262
  Gene Symbol: LRRCC1
  Gene Name: leucine rich repeat and coiled-coil centrosomal protein 1
  ENSP ID: ENSP00000430878

SEQ ID NO: 45466 - protein, 36 aa, Homo sapiens; identical to SEQ ID NO: 45464
  Payload ID: 9262
  Gene Symbol: LRRCC1
  Gene Name: leucine rich repeat and coiled-coil centrosomal protein 1
  ENSP ID: ENSP00000430960

SEQ ID NO: 45467 - protein, 771 aa, Homo sapiens
  Payload ID: 9263
  Gene Symbol: LRFN1
  Gene Name: leucine rich repeat and fibronectin type III domain containing 1
  Uniprot ID: Q9P244
  ENSP ID: ENSP00000248668
MAPGPFSSALLSPPPAALPFLLLLWAGASRGQPCPGRCICQNVAPTLTMLCAKTGLLFVPPAIDRRVVELRLTDNFIAAVRRRDFANMTSLVHLTLSRNTIGQVAAGAFADLRALRALHLDSNRLAEVRGDQLRGLGNLRHLILGNNQIRRVESAAFDAFLSTVEDLDLSYNNLEALPWEAVGQMVNLNTLTLDHNLIDHIAEGTFVQLHKLVRLDMTSNRLHKLPPDGLFLRSQGTGPKPPTPLTVSFGGNPLHCNCELLWLRRLTREDDLETCATPEHLTDRYFWSIPEEEFLCEPPLITRQAGGRALVVEGQAVSLRCRAVGDPEPVVHWVAPDGRLLGNSSRTRVRGDGTLDVTITTLRDSGTFTCIASNAAGEATAPVEVCVVPLPLMAPPPAAPPPLTEPGSSDIATPGRPGANDSAAERRLVAAELTSNSVLIRWPAQRPVPGIRMYQVQYNSSVDDSLVYRMIPSTSQTFLVNDLAAGRAYDLCVLAVYDDGATALPATRVVGCVQFTTAGDPAPCRPLRAHFLGGTMIIAIGGVIVASVLVFIVLLMIRYKVYGDGDSRRVKGSRSLPRVSHVCSQTNGAGTGAAQAPALPAQDHYEALREVESQAAPAVAVEAKAMEAETASAEPEVVLGRSLGGSATSLCLLPSEETSGEESRAAVGPRRSRSGALEPPTSAPPTLALVPGGAAARPRPQQRYSFDGDYGALFQSHSYPRRARRTKRHRSTPHLDGAGGGAAGEDGDLGLGSARACLAFTSTEWMLESTV

SEQ ID NO: 45468 - protein, 789 aa, Homo sapiens
  Payload ID: 9264
  Gene Symbol: LRFN2
  Gene Name: leucine rich repeat and fibronectin type III domain containing 2
  Uniprot ID: Q9ULH4
  ENSP ID: ENSP00000345985
METLLGGLLAFGMAFAVVDACPKYCVCQNLSESLGTLCPSKGLLFVPPDIDRRTVELRLGGNFIIHISRQDFANMTGLVDLTLSRNTISHIQPFSFLDLESLRSLHLDSNRLPSLGEDTLRGLVNLQHLIVNNNQLGGIADEAFEDFLLTLEDLDLSYNNLHGLPWDSVRRMVNLHQLSLDHNLLDHIAEGTFADLQKLARLDLTSNRLQKLPPDPIFARSQASALTATPFAPPLSFSFGGNPLHCNCELLWLRRLERDDDLETCGSPGGLKGRYFWHVREEEFVCEPPLITQHTHKLLVLEGQAATLKCKAIGDPSPLIHWVAPDDRLVGNSSRTAVYDNGTLDIFITTSQDSGAFTCIAANAAGEATAMVEVSIVQLPHLSNSTSRTAPPKSRLSDITGSSKTSRGGGGSGGGEPPKSPPERAVLVSEVTTTSALVKWSVSKSAPRVKMYQLQYNCSDDEVLIYRMIPASNKAFVVNNLVSGTGYDLCVLAMWDDTATTLTATNIVGCAQFFTKADYPQCQSMHSQILGGTMILVIGGIIVATLLVFIVILMVRYKVCNHEAPSKMAAAVSNVYSQTNGAQPPPPSSAPAGAPPQGPPKVVVRNELLDFTASLARASDSSSSSSLGSGEAAGLGRAPWRIPPSAPRPKPSLDRLMGAFASLDLKSQRKEELLDSRTPAGRGAGTSARGHHSDREPLLGPPAARARSLLPLPLEGKAKRSHSFDMGDFAAAAAGGVVPGGYSPPRKVSNIWTKRSLSVNGMLLPFEESDLVGARGTFGSSEWVMESTV

SEQ ID NO: 45469 - protein, 628 aa, Homo sapiens
  Payload ID: 9265
  Gene Symbol: LRFN3
  Gene Name: leucine rich repeat and fibronectin type III domain containing 3
  Uniprot ID: Q9BTN0
  ENSP ID: ENSP00000246529
MAILPLLLCLLPLAPASSPPQSATPSPCPRRCRCQTQSLPLSVLCPGAGLLFVPPSLDRRAAELRLADNFIASVRRRDLANMTGLLHLSLSRNTIRHVAAGAFADLRALRALHLDGNRLTSLGEGQLRGLVNLRHLILSNNQLAALAAGALDDCAETLEDLDLSYNNLEQLPWEALGRLGNVNTLGLDHNLLASVPAGAFSRLHKLARLDMTSNRLTTIPPDPLFSRLPLLARPRGSPASALVLAFGGNPLHCNCELVWLRRLAREDDLEACASPPALGGRYFWAVGEEEFVCEPPVVTHRSPPLAVPAGRPAALRCRAVGDPEPRVRWVSPQGRLLGNSSRARAFPNGTLELLVTEPGDGGIFTCIAANAAGEATAAVELTVGPPPPPQLANSTSCDPPRDGDPDALTPPSAASASAKVADTGPPTDRGVQVTEHGATAALVQWPDQRPIPGIRMYQIQYNSSADDILVYRMIPAESRSFLLTDLASGRTYDLCVLAVYEDSATGLTATRPVGCARFSTEPALRPCGAPHAPFLGGTMIIALGGVIVASVLVFIFVLLMRYKVHGGQPPGKAKIPAPVSSVCSQTNGALGPTPTPAPPAPEPAALRAHTVVQLDCEPWGPGHEPVGP

SEQ ID NO: 45470 - protein, 628 aa, Homo sapiens; identical to SEQ ID NO: 45469
  Payload ID: 9265
  Gene Symbol: LRFN3
  Gene Name: leucine rich repeat and fibronectin type III domain containing 3
  Uniprot ID: Q9BTN0
  ENSP ID: ENSP00000466989

SEQ ID NO: 45471 - protein, 635 aa, Homo sapiens
  Payload ID: 9266
  Gene Symbol: LRFN4
  Gene Name: leucine rich repeat and fibronectin type III domain containing 4
  Uniprot ID: Q6PJG9
  ENSP ID: ENSP00000312535
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSSAEGGRPGPSDIAASARTAAEGEGTLESEPAVQVTEVTATSGLVSWGPGRPADPVWMFQIQYNSSEDETLIYRIVPASSHHFLLKHLVPGADYDLCLLALSPAAGPSDLTATRLLGCAHFSTLPASPLCHALQAHVLGGTLTVAVGGVLVAALLVFTVALLVRGRGAGNGRLPLKLSHVQSQTNGGPSPTPKAHPPRSPPPRPQRSCSLDLGDAGCYGYARRLGGAWARRSHSVHGGLLGAGCRGVGGSAERLEESVV

SEQ ID NO: 45472 - protein, 418 aa, Homo sapiens
  Payload ID: 9266
  Gene Symbol: LRFN4
  Gene Name: leucine rich repeat and fibronectin type III domain containing 4
  ENSP ID: ENSP00000377524
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSRPGAAAWPGSPSLVFILSTSGSPVYLEGQGALSSVLASRPG

SEQ ID NO: 45473 - protein, 719 aa, Homo sapiens
  Payload ID: 9267
  Gene Symbol: LRFN5
  Gene Name: leucine rich repeat and fibronectin type III domain containing 5
  Uniprot ID: Q96NI6
  ENSP ID: ENSP00000298119
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRMIPPTSKTFLVNNLAAGTMYDLCVLAIYDDGITSLTATRVVGCIQFTTEQDYVRCHFMQSQFLGGTMIIIIGGIIVASVLVFIIILMIRYKVCNNNGQHKVTKVSNVYSQTNGAQIQGCSVTLPQSVSKQAVGHEENAQCCKATSDNVIQSSETCSSQDSSTTTSALPPSWTSSTSVSQKQKRKTGTKPSTEPQNEAVTNVESQNTNRNNSTALQLASRPPDSVTEGPTSKRAHIKPNALLTNVDQIVQETQRLELI

SEQ ID NO: 45474 - protein, 466 aa, Homo sapiens
  Payload ID: 9267
  Gene Symbol: LRFN5
  Gene Name: leucine rich repeat and fibronectin type III domain containing 5
  ENSP ID: ENSP00000451067
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRCFAD

SEQ ID NO: 45475 - protein, 465 aa, Homo sapiens
  Payload ID: 9267
  Gene Symbol: LRFN5
  Gene Name: leucine rich repeat and fibronectin type III domain containing 5
  ENSP ID: ENSP00000451897
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRGWS

SEQ ID NO: 45476 - protein, 620 aa, Homo sapiens
  Payload ID: 9268
  Gene Symbol: LINGO1
  Gene Name: leucine rich repeat and Ig domain containing 1
  Uniprot ID: Q96FE5
  ENSP ID: ENSP00000347451
MQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 45477 - protein, 326 aa, Homo sapiens
  Payload ID: 9268
  Gene Symbol: LINGO1
  Gene Name: leucine rich repeat and Ig domain containing 1
  ENSP ID: ENSP00000453780
MVQLEQKVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGG

SEQ ID NO: 45478 - protein, 614 aa, Homo sapiens
  Payload ID: 9268
  Gene Symbol: LINGO1
  Gene Name: leucine rich repeat and Ig domain containing 1
  Uniprot ID: Q96FE5
  ENSP ID: ENSP00000453853
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 45479 - protein, 55 aa, Homo sapiens
  Payload ID: 9268
  Gene Symbol: LINGO1
  Gene Name: leucine rich repeat and Ig domain containing 1
  ENSP ID: ENSP00000454051
MLAGGVRSMPSPLLACWQPILLLVLGSVLSGSATGCPPRCECSAQDRAVLCHRKR

SEQ ID NO: 45480 - protein, 35 aa, Homo sapiens
  Payload ID: 9268
  Gene Symbol: LINGO1
  Gene Name: leucine rich repeat and Ig domain containing 1
  ENSP ID: ENSP00000454245
MLAGGVRSMPSPLLACWQPILLLVLGSVLSGSATG

SEQ ID NO: 45481 - protein, 125 aa, Homo sapiens
  Payload ID: 9268
  Gene Symbol: LINGO1
  Gene Name: leucine rich repeat and Ig domain containing 1
  ENSP ID: ENSP00000454465
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRL

SEQ ID NO: 45482 - protein, 18 aa, Homo sapiens
  Payload ID: 9268
  Gene Symbol: LINGO1
  Gene Name: leucine rich repeat and Ig domain containing 1
  ENSP ID: ENSP00000454577
MLAGGVRSMPSPLLACWQ

SEQ ID NO: 45483 - protein, 72 aa, Homo sapiens
  Payload ID: 9268
  Gene Symbol: LINGO1
  Gene Name: leucine rich repeat and Ig domain containing 1
  ENSP ID: ENSP00000454687
MLAGGVRSMPSPLLACWQPILLLVLGSVLSGSATGCPPRCECSAQDRAVLCHRKRFVAVPEGIPTETRLLDL

SEQ ID NO: 45484 - protein, 178 aa, Homo sapiens
  Payload ID: 9268
  Gene Symbol: LINGO1
  Gene Name: leucine rich repeat and Ig domain containing 1
  ENSP ID: ENSP00000455605
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISH

SEQ ID NO: 45485 - protein, 11 aa, Homo sapiens
  Payload ID: 9268
  Gene Symbol: LINGO1
  Gene Name: leucine rich repeat and Ig domain containing 1
  ENSP ID: ENSP00000456516
MLAGGVRSMPS

SEQ ID NO: 45486 - protein, 4 aa, Homo sapiens
  Payload ID: 9268
  Gene Symbol: LINGO1
  Gene Name: leucine rich repeat and Ig domain containing 1
  ENSP ID: ENSP00000457101
MLAG

SEQ ID NO: 45487 - protein, 606 aa, Homo sapiens
  Payload ID: 9269
  Gene Symbol: LINGO2
  Gene Name: leucine rich repeat and Ig domain containing 2
  Uniprot ID: Q7L985
  ENSP ID: ENSP00000310126
MLHTAISCWQPFLGLAVVLIFMGSTIGCPARCECSAQNKSVSCHRRRLIAIPEGIPIETKILDLSKNRLKSVNPEEFISYPLLEEIDLSDNIIANVEPGAFNNLFNLRSLRLKGNRLKLVPLGVFTGLSNLTKLDISENKIVILLDYMFQDLHNLKSLEVGDNDLVYISHRAFSGLLSLEQLTLEKCNLTAVPTEALSHLRSLISLHLKHLNINNMPVYAFKRLFHLKHLEIDYWPLLDMMPANSLYGLNLTSLSVTNTNLSTVPFLAFKHLVYLTHLNLSYNPISTIEAGMFSDLIRLQELHIVGAQLRTIEPHSFQGLRFLRVLNVSQNLLETLEENVFSSPRALEVLSINNNPLACDCRLLWILQRQPTLQFGGQQPMCAGPDTIRERSFKDFHSTALSFYFTCKKPKIREKKLQHLLVDEGQTVQLECSADGDPQPVISWVTPRRRFITTKSNGRATVLGDGTLEIRFAQDQDSGMYVCIASNAAGNDTFTASLTVKGFASDRFLYANRTPMYMTDSNDTISNGTNANTFSLDLKTILVSTAMGCFTFLGVVLFCFLLLFVWSRGKGKHKNSIDLEYVPRKNNGAVVEGEVAGPRRFNMKMI

SEQ ID NO: 45488 - protein, 606 aa, Homo sapiens; identical to SEQ ID NO: 45487
  Payload ID: 9269
  Gene Symbol: LINGO2
  Gene Name: leucine rich repeat and Ig domain containing 2
  Uniprot ID: Q7L985
  ENSP ID: ENSP00000369328

SEQ ID NO: 45489 - protein, 606 aa, Homo sapiens; identical to SEQ ID NO: 45487
  Payload ID: 9269
  Gene Symbol: LINGO2
  Gene Name: leucine rich repeat and Ig domain containing 2
  Uniprot ID: Q7L985
  ENSP ID: ENSP00000479634

SEQ ID NO: 45490 - protein, 592 aa, Homo sapiens
  Payload ID: 9270
  Gene Symbol: LINGO3
  Gene Name: leucine rich repeat and Ig domain containing 3
  Uniprot ID: P0C6S8
  ENSP ID: ENSP00000467753
MTCWLCVLSLPLLLLPAAPPPAGGCPARCECTVQTRAVACTRRRLTAVPDGIPAETRLLELSRNRIRCLNPGDLAALPALEELDLSENAIAHVEPGAFANLPRLRVLRLRGNQLKLIPPGVFTRLDNLTLLDLSENKLVILLDYTFQDLHSLRRLEVGDNDLVFVSRRAFAGLLALEELTLERCNLTALSGESLGHLRSLGALRLRHLAIASLEDQNFRRLPGLLHLEIDNWPLLEEVAAGSLRGLNLTSLSVTHTNITAVPAAALRHQAHLTCLNLSHNPISTVPRGSFRDLVRLRELHLAGALLAVVEPQAFLGLRQIRLLNLSNNLLSTLEESTFHSVNTLETLRVDGNPLACDCRLLWIVQRRKTLNFDGRLPACATPAEVRGDALRNLPDSVLFEYFVCRKPKIRERRLQRVTATAGEDVRFLCRAEGEPAPTVAWVTPQHRPVTATSAGRARVLPGGTLEIQDARPQDSGTYTCVASNAGGNDTYFATLTVRPEPAANRTPGEAHNETLAALRAPLDLTTILVSTAMGCITFLGVVLFCFVLLFVWSRGRGQHKNNFSVEYSFRKVDGPAAAAGQGGARKFNMKMI

SEQ ID NO: 45491 - protein, 593 aa, Homo sapiens
  Payload ID: 9271
  Gene Symbol: LINGO4
  Gene Name: leucine rich repeat and Ig domain containing 4
  Uniprot ID: Q6UY18
  ENSP ID: ENSP00000357810
MDAATAPKQAWPPWPPLLFLLLLPGGSGGSCPAVCDCTSQPQAVLCGHRQLEAVPGGLPLDTELLDLSGNRLWGLQQGMLSRLSLLQELDLSYNQLSTLEPGAFHGLQSLLTLRLQGNRLRIMGPGVFSGLSALTLLDLRLNQIVLFLDGAFGELGSLQKLEVGDNHLVFVAPGAFAGLAKLSTLTLERCNLSTVPGLALARLPALVALRLRELDIGRLPAGALRGLGQLKELEIHLWPSLEALDPGSLVGLNLSSLAITRCNLSSVPFQALYHLSFLRVLDLSQNPISAIPARRLSPLVRLQELRLSGACLTSIAAHAFHGLTAFHLLDVADNALQTLEETAFPSPDKLVTLRLSGNPLTCDCRLLWLLRLRRHLDFGMSPPACAGPHHVQGKSLKEFSDILPPGHFTCKPALIRKSGPRWVIAEEGGHAVFSCSGDGDPAPTVSWMRPHGAWLGRAGRVRVLEDGTLEIRSVQLRDRGAYVCVVSNVAGNDSLRTWLEVIQVEPPNGTLSDPNITVPGIPGPFFLDSRGVAMVLAVGFLPFLTSVTLCFGLIALWSKGKGRVKHHMTFDFVAPRPSGDKNSGGNRVTAKLF

SEQ ID NO: 45492 - protein, 723 aa, Homo sapiens
  Payload ID: 9272
  Gene Symbol: LRSAM1
  Gene Name: leucine rich repeat and sterile alpha motif containing 1
  Uniprot ID: Q6UWE0
  ENSP ID: ENSP00000300417
MPLFFRKRKPSEEARKRLEYQMCLAKEAGADDILDISKCELSEIPFGAFATCKVLQKKVLIVHTNHLTSLLPKSCSLLSLATIKVLDLHDNQLTALPDDLGQLTALQVLNVERNQLMQLPRSIGNLTQLQTLNVKDNKLKELPDTVGELRSLRTLNISGNEIQRLPQMLAHVRTLEMLSLDASAMVYPPREVCGAGTAAILQFLCKESGLEYYPPSQYLLPILEQDGIENSRDSPDGPTDRFSREELEWQNRFSDYEKRKEQKMLEKLEFERRLELGQREHTQLLQQSSSQKDEILQTVKEEQSRLEQGLSEHQRHLNAERQRLQEQLKQTEQNISSRIQKLLQDNQRQKKSSEILKSLENERIRMEQLMSITQEETESLRRRDVASAMQQMLTESCKNRLIQMAYESQRQNLVQQACSSMAEMDERFQQILSWQQMDQNKAISQILQESAMQKAAFEALQVKKDLMHRQIRSQIKLIETELLQLTQLELKRKSLDTESLQEMISEQRWALSSLLQQLLKEKQQREEELREILTELEAKSETRQENYWLIQYQRLLNQKPLSLKLQEEGMERQLVALLEELSAEHYLPIFAHHRLSLDLLSQMSPGDLAKVGVSEAGLQHEILRRVQELLDAARIQPELKPPMGEVVTPTAPQEPPESVRPSAPPAELEVQASECVVCLEREAQMIFLNCGHVCCCQQCCQPLRTCPLCRQDIAQRLRIYHSS

SEQ ID NO: 45493 - protein, 723 aa, Homo sapiens; identical to SEQ ID NO: 45492
  Payload ID: 9272
  Gene Symbol: LRSAM1
  Gene Name: leucine rich repeat and sterile alpha motif containing 1
  Uniprot ID: Q6UWE0
  ENSP ID: ENSP00000322937

SEQ ID NO: 45494 - protein, 723 aa, Homo sapiens; identical to SEQ ID NO: 45492
  Payload ID: 9272
  Gene Symbol: LRSAM1
  Gene Name: leucine rich repeat and sterile alpha motif containing 1
  Uniprot ID: Q6UWE0
  ENSP ID: ENSP00000362419

SEQ ID NO: 45495 - protein, 696 aa, Homo sapiens
  Payload ID: 9272
  Gene Symbol: LRSAM1
  Gene Name: leucine rich repeat and sterile alpha motif containing 1
  Uniprot ID: Q6UWE0
  ENSP ID: ENSP00000362421
MPLFFRKRKPSEEARKRLEYQMCLAKEAGADDILDISKCELSEIPFGAFATCKVLQKKVLIVHTNHLTSLLPKSCSLLSLATIKVLDLHDNQLTALPDDLGQLTALQVLNVERNQLMQLPRSIGNLTQLQTLNVKDNKLKELPDTVGELRSLRTLNISGNEIQRLPQMLAHVRTLEMLSLDASAMVYPPREVCGAGTAAILQFLCKESGLEYYPPSQYLLPILEQDGIENSRDSPDGPTDRFSREELEWQNRFSDYEKRKEQKMLEKLEFERRLELGQREHTQLLQQSSSQKDEILQTVKEEQSRLEQGLSEHQRHLNAERQRLQEQLKQTEQNISSRIQKLLQDNQRQKKSSEILKSLENERIRMEQLMSITQEETESLRRRDVASAMQQMLTESCKNRLIQMAYESQRQNLVQQACSSMAEMDERFQQILSWQQMDQNKAISQILQESAMQKAAFEALQVKKDLMHRQIRSQEMISEQRWALSSLLQQLLKEKQQREEELREILTELEAKSETRQENYWLIQYQRLLNQKPLSLKLQEEGMERQLVALLEELSAEHYLPIFAHHRLSLDLLSQMSPGDLAKVGVSEAGLQHEILRRVQELLDAARIQPELKPPMGEVVTPTAPQEPPESVRPSAPPAELEVQASECVVCLEREAQMIFLNCGHVCCCQQCCQPLRTCPLCRQDIAQRLRIYHSS

SEQ ID NO: 45496 - protein, 154 aa, Homo sapiens
  Payload ID: 9273
  Gene Symbol: LRRC1
  Gene Name: leucine rich repeat containing 1
  ENSP ID: ENSP00000359919
MFHCIPLWRCNRHVESIDKRHCSLVYVPEEIYRYARSLEELLLDANQLRELPEQFFQLVKLRKLGLSDNEIQRLPPEIANFMQLVELDVSRNEIPEIPESISFCKALQVADFSGNPLTRLPESFPELQNLTCLSVNDISLQSLPENIGKQKTTS

SEQ ID NO: 45497 - protein, 524 aa, Homo sapiens
  Payload ID: 9273
  Gene Symbol: LRRC1
  Gene Name: leucine rich repeat containing 1
  Uniprot ID: Q9BTT6
  ENSP ID: ENSP00000359925
MFHCIPLWRCNRHVESIDKRHCSLVYVPEEIYRYARSLEELLLDANQLRELPEQFFQLVKLRKLGLSDNEIQRLPPEIANFMQLVELDVSRNEIPEIPESISFCKALQVADFSGNPLTRLPESFPELQNLTCLSVNDISLQSLPENIGNLYNLASLELRENLLTYLPDSLTQLRRLEELDLGNNEIYNLPESIGALLHLKDLWLDGNQLSELPQEIGNLKNLLCLDVSENRLERLPEEISGLTSLTDLVISQNLLETIPDGIGKLKKLSILKVDQNRLTQLPEAVGECESLTELVLTENQLLTLPKSIGKLKKLSNLNADRNKLVSLPKEIGGCCSLTVFCVRDNRLTRIPAEVSQATELHVLDVAGNRLLHLPLSLTALKLKALWLSDNQSQPLLTFQTDTDYTTGEKILTCVLLPQLPSEPTCQENLPRCGALENLVNDVSDEAWNERAVNRVSAIRFVEDEKDEEDNETRTLLRRATPHPGELKHMKKTVENLRNDMNAAKGLDSNKNEVNHAIDRVTTSV

SEQ ID NO: 45498 - protein, 197 aa, Homo sapiens
  Payload ID: 9273
  Gene Symbol: LRRC1
  Gene Name: leucine rich repeat containing 1
  Uniprot ID: Q9BTT6
  ENSP ID: ENSP00000435217
MFHCIPLWRCNRHVESIDKRHCSLVYVPEEIYRYARSLEELLLDANQLRELPEQFFQLVKLRKLGLSDNEIQRLPPEIANFMQLVELDVSRNEIPEIPESISFCKALQVADFSGNPLTRLPESFPELQNLTCLSVNDISLQSLPENIGNLYNLASLELRENLLTYLPDSLTQLRRLEELDLGNNEIYNLNQLEPSYI

SEQ ID NO: 45499 - protein, 277 aa, Homo sapiens
  Payload ID: 9274
  Gene Symbol: LRRC10
  Gene Name: leucine rich repeat containing 10
  Uniprot ID: Q5BKY1
  ENSP ID: ENSP00000355166
MGNTIRALVAFIPADRCQNYVVRDLREMPLDKMVDLSGSQLRRFPLHVCSFRELVKLYLSDNHLNSLPPELGQLQNLQILALDFNNFKALPQVVCTLKQLCILYLGNNKLCDLPSELSLLQNLRTLWIEANCLTQLPDVVCELSLLKTLHAGSNALRLLPGQLRRLQELRTIWLSGNRLTDFPTVLLHMPFLEVIDVDWNSIRYFPSLAHLSSLKLVIYDHNPCRNAPKVAKGVRRVGRWAEETPEPDPRKARRYALVREESQELQAPVPLLPPTNS

SEQ ID NO: 45500 - protein, 292 aa, Homo sapiens
  Payload ID: 9275
  Gene Symbol: LRRC10B
  Gene Name: leucine rich repeat containing 10B
  Uniprot ID: A6NIK2
  ENSP ID: ENSP00000367315
MGIAESTPDELPSDAEEQLRSGDQQLELSGRRLRRLPSAVCALSRLQKLYVSGTGLRELPEEIEELRELRILALDFNKLERLPDGLCRLPRLTRLYLGGNRLLALPADFAQLQSLRCLWIEGNFLRRFPRPLLRLVALQSLQMGDNRLRALPAELPRMTGLRGLWLYGNRFEEFPPALLRMGRLHILDLDRNRLGGFPDLHPLRALRVFSYDHNPVTGPPRVADTVFLVGEGAVERMAERDEPTPRPPPRRPARAFEDEEEEDLLIGGAGSRALGAPGGSFRALEAAPGLGT

SEQ ID NO: 45501 - protein, 493 aa, Homo sapiens
  Payload ID: 9276
  Gene Symbol: LRRC14
  Gene Name: leucine rich repeat containing 14
  Uniprot ID: Q15048
  ENSP ID: ENSP00000292524
MHTLVFLSTRQVLQCQPAACQALPLLPRELFPLLFKVAFMDKKTVVLRELVHTWPFPLLSFQQLLQECAHCSRALLQERPSTESMQAVILGLTARLHTSEPGASTQPLCRKHALRVLDMTGLLDDGVEQDPGTMSMWDCTAAVARTCIAQQQGGAAEPGPAPIPVEVRVDLRVNRASYAFLREALRSSVGSPLRLCCRDLRAEDLPMRNTVALLQLLDAGCLRRVDLRFNNLGLRGLSVIIPHVARFQHLASLRLHYVHGDSRQPSVDGEDNFRYFLAQMGRFTCLRELSMGSSLLSGRLDQLLSTLQSPLESLELAFCALLPEDLRFLARSPHAAHLKKLDLSGNDLSGSQLAPFQGLLQASAATLLHLELTECQLADTQLLATLPILTQCASLRYLGLYGNPLSMAGLKELLRDSVAQAELRTVVHPFPVDCYEGLPWPPPASVLLEASINEEKFARVEAELHQLLLASGRAHVLWTTDIYGRLAADYFSL

SEQ ID NO: 45502 - protein, 159 aa, Homo sapiens
  Payload ID: 9276
  Gene Symbol: LRRC14
  Gene Name: leucine rich repeat containing 14
  ENSP ID: ENSP00000434738
MHTLVFLSTRQVLQCQPAACQALPLLPRELFPLLFKVAFMDKKTVVLRELVHTWPFPLLSFQQLLQECAHCSRALLQERPSTESMQAVILGLTARLHTSEPGASTQPLCRKHALRVLDMTGLLDDGVEQDPGTMSMWDCTAAVARTCIAQQQGGAAEPG

SEQ ID NO: 45503 - protein, 493 aa, Homo sapiens; identical to SEQ ID NO: 45501
  Payload ID: 9276
  Gene Symbol: LRRC14
  Gene Name: leucine rich repeat containing 14
  Uniprot ID: Q15048
  ENSP ID: ENSP00000434768

SEQ ID NO: 45504 - protein, 86 aa, Homo sapiens
  Payload ID: 9276
  Gene Symbol: LRRC14
  Gene Name: leucine rich repeat containing 14
  ENSP ID: ENSP00000435985
MHTLVFLSTRQVLQCQPAACQALPLLPRELFPLLFKVAFMDKKTVVLRELVHTWPFPLLSFQQLLQECAHCSRALLQERPSTESMQ

SEQ ID NO: 45505 - protein, 301 aa, Homo sapiens
  Payload ID: 9276
  Gene Symbol: LRRC14
  Gene Name: leucine rich repeat containing 14
  ENSP ID: ENSP00000436452
MHTLVFLSTRQVLQCQPAACQALPLLPRELFPLLFKVAFMDKKTVVLRELVHTWPFPLLSFQQLLQECAHCSRALLQERPSTESMQAVILGLTARLHTSEPGASTQPLCRKHALRVLDMTGLLDDGVEQDPGTMSMWDCTAAVARTCIAQQQGGAAEPGPAPIPVEVRVDLRVNRASYAFLREALRSSVGSPLRLCCRDLRAEDLPMRNTVALLQLLDAGCLRRVDLRFNNLGLRGLSVIIPHVARFQHLASLRLHYVHGDSRQPSVDGEDNFRYFLAQMGRFTCLRELSMGSSLLSGRLD

SEQ ID NO: 45506 - protein, 514 aa, Homo sapiens
  Payload ID: 9277
  Gene Symbol: LRRC14B
  Gene Name: leucine rich repeat containing 14B
  Uniprot ID: A6NHZ5
  ENSP ID: ENSP00000327675
MDTMRSLRFISAEALVSHPQVARQSLDSVAHNLYPLLFKASYLLEQAEVTRAVLGRWPLEEFRLGALLGPGADHPQDLRDRTCRACLEALVRGLADHVLQDRSRRRLRVADLTGIRDVQVQRCPCGRALGRWGRTQLLARTCCELQAEPLAAGRPVEVLADLFVTEGNFEAVVQALRPAGPAPLRVHCPSFRADSLSPSQLLHVLRLAGPGALRKLEVVHNVRLHAGHVQQLLAQVGFPRLASLTLPTKAFDAPPTYASTPDGEDPLLASIARELSKMAQLTELSVAFSTLTGKIPTLLGPLQTPLRVLDLANCALNHTDMAFLADCAHAAHLEVLDLSGHNLVSLYPSTFFRLLSQASRTLRILTLEECGIVDSHVGMLILGLSPCHRLRQLKFLGNPLSARALRRLFTALCELPELRCIEFPVPKDCYPEGAAYPQDELAMSKFNQQKYDEIAEELRAVLLRADREDIQVSTPLFGSFDPDIQETSNELGAFLLQAFKTALENFSRALKQIE

SEQ ID NO: 45507 - protein, 581 aa, Homo sapiens
  Payload ID: 9278
  Gene Symbol: LRRC15
  Gene Name: leucine rich repeat containing 15
  Uniprot ID: Q8TF66
  ENSP ID: ENSP00000306276
MPLKHYLLLLVGCQAWGAGLAYHGCPSECTCSRASQVECTGARIVAVPTPLPWNAMSLQILNTHITELNESPFLNISALIALRIEKNELSRITPGAFRNLGSLRYLSLANNKLQVLPIGLFQGLDSLESLLLSSNQLLQIQPAHFSQCSNLKELQLHGNHLEYIPDGAFDHLVGLTKLNLGKNSLTHISPRVFQHLGNLQVLRLYENRLTDIPMGTFDGLVNLQELALQQNQIGLLSPGLFHNNHNLQRLYLSNNHISQLPPSVFMQLPQLNRLTLFGNSLKELSPGIFGPMPNLRELWLYDNHISSLPDNVFSNLRQLQVLILSRNQISFISPGAFNGLTELRELSLHTNALQDLDGNVFRMLANLQNISLQNNRLRQLPGNIFANVNGLMAIQLQNNQLENLPLGIFDHLGKLCELRLYDNPWRCDSDILPLRNWLLLNQPRLGTDTVPVCFSPANVRGQSLIIINVNVAVPSVHVPEVPSYPETPWYPDTPSYPDTTSVSSTTELTSPVEDYTDLTTIQVTDDRSVWGMTQAQSGLAIAAIVIGIVALACSLAACVGCCCCKKRSQAVLMQMKAPNEC

SEQ ID NO: 45508 - protein, 587 aa, Homo sapiens
  Payload ID: 9278
  Gene Symbol: LRRC15
  Gene Name: leucine rich repeat containing 15
  Uniprot ID: Q8TF66
  ENSP ID: ENSP00000413707
MPLDKAMPLKHYLLLLVGCQAWGAGLAYHGCPSECTCSRASQVECTGARIVAVPTPLPWNAMSLQILNTHITELNESPFLNISALIALRIEKNELSRITPGAFRNLGSLRYLSLANNKLQVLPIGLFQGLDSLESLLLSSNQLLQIQPAHFSQCSNLKELQLHGNHLEYIPDGAFDHLVGLTKLNLGKNSLTHISPRVFQHLGNLQVLRLYENRLTDIPMGTFDGLVNLQELALQQNQIGLLSPGLFHNNHNLQRLYLSNNHISQLPPSVFMQLPQLNRLTLFGNSLKELSPGIFGPMPNLRELWLYDNHISSLPDNVFSNLRQLQVLILSRNQISFISPGAFNGLTELRELSLHTNALQDLDGNVFRMLANLQNISLQNNRLRQLPGNIFANVNGLMAIQLQNNQLENLPLGIFDHLGKLCELRLYDNPWRCDSDILPLRNWLLLNQPRLGTDTVPVCFSPANVRGQSLIIINVNVAVPSVHVPEVPSYPETPWYPDTPSYPDTTSVSSTTELTSPVEDYTDLTTIQVTDDRSVWGMTQAQSGLAIAAIVIGIVALACSLAACVGCCCCKKRSQAVLMQMKAPNEC

SEQ ID NO: 45509 - protein, 1371 aa, Homo sapiens
  Payload ID: 9279
  Gene Symbol: LRRC16A
  Gene Name: leucine rich repeat containing 16A
  Uniprot ID: Q5VZK9
  ENSP ID: ENSP00000331983
MTEESSDVPRELIESIKDVIGRKIKISVKKKVKLEVKGDKVENKVLVLTSCRAFLVTARIPTKLELTFSYLEIHGVVCSKSAQMIVETEKCSISMKMASPEDVSEVLAHIGTCLRKIFPGLSPVRIMKKVSMEPSERLASLQALWDSQTVAEQGPCGGFSQMYACVCDWLGFSYREEVQWDVDTIYLTQDTRELNLQDFSHLDHRDLIPIIAALEYNQWFTKLSSKDLKLSTDVCEQILRVVSRSNRLEELVLENAGLRTDFAQKLASALAHNPNSGLHTINLAGNPLEDRGVSSLSIQFAKLPKGLKHLNLSKTSLSPKGVNSLSQSLSANPLTASTLVHLDLSGNVLRGDDLSHMYNFLAQPNAIVHLDLSNTECSLDMVCGALLRGCLQYLAVLNLSRTVFSHRKGKEVPPSFKQFFSSSLALMHINLSGTKLSPEPLKALLLGLACNHNLKGVSLDLSNCELRSGGAQVLEGCIAEIHNITSLDISDNGLESDLSTLIVWLSKNRSIQHLALGKNFNNMKSKNLTPVLDNLVQMIQDEESPLQSLSLADSKLKTEVTIIINALGSNTSLTKVDISGNGMGDMGAKMLAKALQINTKLRTVIWDKNNITAQGFQDIAVAMEKNYTLRFMPIPMYDASQALKTNPEKTEDALQKIENYLLRNHETRKYLQEQAYRLQQGIVTSTTQQMIDRICVKVQDHLNSLRNCGGDAIQEDLKSAERLMRDAKNSKTLLPNLYHVGGASWAGASGLLSSPIQETLESMAGEVTRVVDEQLKALLESMVDAAENLCPNVMKKAHIRQDLIHASTEKISIPRTFVKNVLLEQSGIDILNKISEVKLTVASFLSDRIVDEILDALSHCHHKLADHFSRRGKTLPQQESLEIELAEEKPVKRSIITVEELTEIERLEDLDTCMMTPKSKRKSIHSRMLRPVSRAFEMEFDLDKALEEVPIHIEDPPFPSLRQEKRSSGFISELPSEEGKKLEHFTKLRPKRNKKQQPTQAAVCAANIVSQDGEQNGLMGRVDEGVDEFFTKKVTKMDSKKWSTRGSESHELNEGGDEKKKRDSRKSSGFLNLIKSRSKSERPPTILMTEEPSSPKGAVRSPPVDCPRKDTKAAEHNGNSERIEEIKTPDSFEESQGEEIGKVERSDSKSSPQAGRRYGVQVMGSGLLAEMKAKQEKRAACAQKKLGNDAVSQDSSSPALSGVERSDGGGAVPKLHPGLPENRFGLGTPEKNTKAEPKAEAGSRSRSSSSTPTSPKPLLQSPKPSLAARPVIPQKPRTASRPDDIPDSPSSPKVALLPPVLKKVPSDKERDGQSSPQPSPRTFSQEVSRRSWGQQAQEYQEQKQRSSSKDGHQGSKSNDSGEEAEKEFIFV

SEQ ID NO: 45510 - protein, 932 aa, Homo sapiens
  Payload ID: 9279
  Gene Symbol: LRRC16A
  Gene Name: leucine rich repeat containing 16A
  ENSP ID: ENSP00000489114
EVPPSFKQFFSSSLALMHINLSGTKLSPEPLKALLLGLACNHNLKGVSLDLSNCELGHCLRSGGAQVLEGCIAEIHNITSLDISDNGLESDLSTLIVWLSKNRSIQHLALGKNFNNMKSKNLTPVLDNLVQMIQDEESPLQSLSLADSKLKTEVTIIINALGSNTSLTKVDISGNGMGDMGAKMLAKALQINTKLRTVIWDKNNITAQGFQDIAVAMEKNYTLRFMPIPMYDASQALKTNPEKTEDALQKIENYLLRNHETRKYLQEQAYRLQQGIVTSTTQQMIDRICVKVQDHLNSLRNCGGDAIQEDLKSAERLMRDAKNSKTLLPNLYHVGGASWAGASGLLSSPIQETLESMAGEVTRVVDEQLKALLESMVDAAENLCPNVMKKAHIRQDLIHASTEKISIPRTFVKNVLLEQSGIDILNKISEVKLTVASFLSDRIVDEILDALSHCHHKLADHFSRRGKTLPQQESLEIELAEEKPVKRSIITVEELTEIERLEDLDTCMTLCCTSMTPKSKRKSIHSRMLRPVSRAFEMEFDLDKALEEVPIHIEDPPFPSLRQEKRSSGFISELPSEEGKKLEHFTKLRPKRNKKQQPTQAAVCAANIVSQDGEQNGLMGRVDEGVDEFFTKKVTKMDSKKWSTRGSESHELNEGGDEKKKRDSRKSSGFLNLIKSRSKSERPPTILMTEEPSSPKGAVRSPPVDCPRKDTKAAEHNGNSERIEEIKTPDSFEESQGEEIGKVERSDSKSSPQAGRRYGVQVMGSGLLAEMKAKQEKRAACAQKKLGNDAVSQDSSSPALSGVERSDGGGAVPKLHPGLPENRFGLGTPEKNTKAEPKAEAGSRSRSSSSTPTSPKPLLQSPKPSLAARPVIPQKPRTASRPDDIPDSPSSPKVALLPPVLKKVPSDKERDGQSSPQPSPRTFSQEACPTNF

SEQ ID NO: 45511 - protein, 196 aa, Homo sapiens
  Payload ID: 9279
  Gene Symbol: LRRC16A
  Gene Name: leucine rich repeat containing 16A
  ENSP ID: ENSP00000489403
MIVETEKCSISMKMASPEDVSEVLAHIGTCLRKIFPGLSPVRIMKKVSMEPSERLASLQALWDSQTVAEQGPCGGFSQMYACVCDWLGFSYREEVQWDVDTIYLTQDTRELNLQDFSHLDHRKSRIAVWSLKSSSQLNRPGKKYTSWIYLLFAQPGTTEDGEAGSAVSVVVADGPKASSSQAIFFFSCLEQFSFFL

SEQ ID NO: 45512 - protein, 1372 aa, Homo sapiens
  Payload ID: 9280
  Gene Symbol: LRRC16B
  Gene Name: leucine rich repeat containing 16B
  Uniprot ID: Q8ND23
  ENSP ID: ENSP00000340467
MAKPSVELTRELQDSIRRCLSQGAVLQQHHVKLETKPKKFEDRVLALTSWRLHLFLLKVPAKVESSFNVLEIRAFNTLSQNQILVETERGMVSMRLPSAESVDQVTRHVSSALSKVCPGPGCLIRRGNADTPEGPRDTSPNSETSTSTTHSVCGGFSETYAALCDYNGLHCREEVQWDVDTIYHAEDNREFNLLDFSHLESRDLALMVAALAYNQWFTKLYCKDLRLGSEVLEQVLHTLSKSGSLEELVLDNAGLKTDFVQKLAGVFGENGSCVLHALTLSHNPIEDKGFLSLSQQLLCFPSGLTKLCLAKTAISPRGLQALGQTFGANPAFASSLRYLDLSKNPGLLATDEANALYSFLAQPNALVHLDLSGTDCVIDLLLGALLHGCCSHLTYLNLARNSCSHRKGREAPPAFKQFFSSAYTLSHVNLSATKLPLEALRALLQGLSLNSHLSDLHLDLSSCELRSAGAQALQEQLGAVTCVGSLDLSDNGFDSDLLTLVPALGKNKSLKHLFLGKNFNVKAKTLEEILHKLVQLIQEEDCSLQSLSVADSRLKLRTSILINALGSNTCLAKVDLSGNGMEDIGAKMLSKALQINSSLRTILWDRNNTSALGFLDIARALESNHTLRFMSFPVSDISQAYRSAPERTEDVWQKIQWCLVRNNHSQTCPQEQAFRLQQGLVTSSAEQMLQRLCGRVQEEVRALRLCPLEPVQDELLYARDLIKDAKNSRALFPSLYELGHVLANDGPVRQRLESVASEVSKAVDKELQVILESMVSLTQELCPVAMRVAEGHNKMLSNVAERVTVPRNFIRGALLEQAGQDIQNKLDEVKLSVVTYLTSSIVDEILQELYHSHKSLARHLTQLRTLSDPPGCPGQGQDLSSRGRGRNHDHEETTDDELGTNIDTMAIKKQKRCRKIRPVSAFISGSPQDMESQLGNLGIPPGWFSGLGGSQPTASGSWEGLSELPTHGYKLRHQTQGRPRPPRTTPPGPGRPSMPAPGTRQENGMATRLDEGLEDFFSRRVLEESSSYPRTLRTVRPGLSEAPLPPLQKKRRRGLFHFRRPRSFKGDRGPGSPTTGLLLPPPPPPPPTQESPPSPDPPSLGNNSSPCWSPEEESSLLPGFGGGRGPSFRRKMGTEGSEPGEGGPAPGTAQQPRVHGVALPGLERAKGWSFDGKREGPGPDQEGSTQAWQKRRSSDDAGPGSWKPPPPPQSTKPSFSAMRRAEATWHIAEESAPNHSCQSPSPASQDGEEEKEGTLFPERTLPARNAKLQDPALAPWPPKPVAVPRGRQPPQEPGVREEAEAGDAAPGVNKPRLRLSSQQDQEEPEVQGPPDPGRRTAPLKPKRTRRAQSCDKLEPDRRRPPDPTGTSEPGTD

SEQ ID NO: 45513 - protein, 313 aa, Homo sapiens
  Payload ID: 9281
  Gene Symbol: LRRC17
  Gene Name: leucine rich repeat containing 17
  Uniprot ID: Q8N6Y2
  ENSP ID: ENSP00000249377
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEEKEQLDPKPQVSGRPPVIKPEVDSTFCHNYVFPIQTLDCKRKELKKVPNNIPPDIVKLDLSYNKINQLRPKEFEDVHELKKLNLSSNGIEFIDPGSLR

SEQ ID NO: 45514 - protein, 441 aa, Homo sapiens
  Payload ID: 9281
  Gene Symbol: LRRC17
  Gene Name: leucine rich repeat containing 17
  Uniprot ID: Q8N6Y2
  ENSP ID: ENSP00000344242
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEEKEQLDPKPQVSGRPPVIKPEVDSTFCHNYVFPIQTLDCKRKELKKVPNNIPPDIVKLDLSYNKINQLRPKEFEDVHELKKLNLSSNGIEFIDPAAFLGLTHLEELDLSNNSLQNFDYGVLEDLYFLKLLWLRDNPWRCDYNIHYLYYWLKHHYNVHFNGLECKTPEEYKGWSVGKYIRSYYEECPKDKLPAYPESFDQDTEDDEWEKKHRDHTAKKQSVIITIVG

SEQ ID NO: 45515 - protein, 104 aa, Homo sapiens
  Payload ID: 9281
  Gene Symbol: LRRC17
  Gene Name: leucine rich repeat containing 17
  ENSP ID: ENSP00000394194
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKF

SEQ ID NO: 45516 - protein, 261 aa, Homo sapiens
  Payload ID: 9282
  Gene Symbol: LRRC18
  Gene Name: leucine rich repeat containing 18
  Uniprot ID: Q8N456
  ENSP ID: ENSP00000298124
MVKGEKGPKGKKITLKVARNCIKITFDGKKRLDLSKMGITTFPKCILRLSDMDELDLSRNLIRKIPDSISKFQNLRWLDLHSNYIDKLPESIGQMTSLLYLNVSNNRLTSNGLPVELKQLKNIRAVNLGLNHLDSVPTTLGALKELHEVGLHDNLLNNIPVSISKLPKLKKLNIKRNPFPKPGESEIFIDSIRRLENLYVVEEKDLCAACLRKCQNARDNLNRIKNMATTTPRKTIFPNLISPNSMAKDSWEDWRIRLTSS

SEQ ID NO: 45517 - protein, 261 aa, Homo sapiens; identical to SEQ ID NO: 45516
  Payload ID: 9282
  Gene Symbol: LRRC18
  Gene Name: leucine rich repeat containing 18
  Uniprot ID: Q8N456
  ENSP ID: ENSP00000363275

SEQ ID NO: 45518 - protein, 370 aa, Homo sapiens
  Payload ID: 9283
  Gene Symbol: LRRC19
  Gene Name: leucine rich repeat containing 19
  Uniprot ID: Q9H756
  ENSP ID: ENSP00000369395
MKVTGITILFWPLSMILLSDKIQSSKREVQCNFTEKNYTLIPADIKKDVTILDLSYNQITLNGTDTRVLQTYFLLTELYLIENKVTILHNNGFGNLSSLEILNICRNSIYVIQQGAFLGLNKLKQLYLCQNKIEQLNADVFVPLRSLKLLNLQGNLISYLDVPPLFHLELITLYGNLWNCSCSLFNLQNWLNTSNVTLENENITMCSYPNSLQSYNIKTVPHKAECHSKFPSSVTEDLYIHFQPISNSIFNSSSNNLTRNSEHEPLGKSWAFLVGVVVTVLTTSLLIFIAIKCPIWYNILLSYNHHRLEEHEAETYEDGFTGNPSSLSQIPETNSEETTVIFEQLHSFVVDDDGFIEDKYIDIHELCEEN

SEQ ID NO: 45519 - protein, 371 aa, Homo sapiens
  Payload ID: 9284
  Gene Symbol: LRRC2
  Gene Name: leucine rich repeat containing 2
  Uniprot ID: Q9BYS8
  ENSP ID: ENSP00000296144
MGHKVVVFDISVIRALWETRVKKHKAWQKKEVERLEKSALEKIKEEWNFVAECRRKGIPQAVYCKNGFIDTSVRLLDKIERNTLTRQSSLPKDRGKRSSAFVFELSGEHWTELPDSLKEQTHLREWYISNTLIQIIPTYIQLFQAMRILDLPKNQISHLPAEIGCLKNLKELNVGFNYLKSIPPELGDCENLERLDCSGNLELMELPFELSNLKQVTFVDISANKFSSVPICVLRMSNLQWLDISSNNLTDLPQDIDRLEELQSFLLYKNKLTYLPYSMLNLKKLTLLVVSGDHLVELPTALCDSSTPLKFVSLMDNPIDNAQCEDGNEIMESERDRQHFDKEVMKAYIEDLKERESVPSYTTKVSFSLQL

SEQ ID NO: 45520 - protein, 371 aa, Homo sapiens; identical to SEQ ID NO: 45519
  Payload ID: 9284
  Gene Symbol: LRRC2
  Gene Name: leucine rich repeat containing 2
  Uniprot ID: Q9BYS8
  ENSP ID: ENSP00000379241

SEQ ID NO: 45521 - protein, 184 aa, Homo sapiens
  Payload ID: 9285
  Gene Symbol: LRRC20
  Gene Name: leucine rich repeat containing 20
  Uniprot ID: Q8TCA0
  ENSP ID: ENSP00000348043
MLKKMGEAVARVARKVNETVESGSDTLDLAECKLVSFPIGIYKVLRNVSGQIHLITLANNELKSLTSKFMTTFSQLRELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 45522 - protein, 128 aa, Homo sapiens
  Payload ID: 9285
  Gene Symbol: LRRC20
  Gene Name: leucine rich repeat containing 20
  Uniprot ID: Q8TCA0
  ENSP ID: ENSP00000350255
MLKKMGEAVARVARKVNETVESGSDTLDLAECKLVSFPIGIYKVLRNVSGQIHLITLANNELKSLTSKFMTTFSQLRDVPVEKLAAMPALRSINLRFNPLNAEVRVIAPPLIKFDMLMSPEGARAPLP

SEQ ID NO: 45523 - protein, 134 aa, Homo sapiens
  Payload ID: 9285
  Gene Symbol: LRRC20
  Gene Name: leucine rich repeat containing 20
  Uniprot ID: Q8TCA0
  ENSP ID: ENSP00000350860
MLKKMGEAVARVARKVNETVESGSDTLELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 45524 - protein, 184 aa, Homo sapiens; identical to SEQ ID NO: 45521
  Payload ID: 9285
  Gene Symbol: LRRC20
  Gene Name: leucine rich repeat containing 20
  Uniprot ID: Q8TCA0
  ENSP ID: ENSP00000362321

SEQ ID NO: 45525 - protein, 115 aa, Homo sapiens
  Payload ID: 9285
  Gene Symbol: LRRC20
  Gene Name: leucine rich repeat containing 20
  ENSP ID: ENSP00000378457
MTTFSQLRELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 45526 - protein, 134 aa, Homo sapiens; identical to SEQ ID NO: 45523
  Payload ID: 9285
  Gene Symbol: LRRC20
  Gene Name: leucine rich repeat containing 20
  Uniprot ID: Q8TCA0
  ENSP ID: ENSP00000378458

SEQ ID NO: 45527 - protein, 174 aa, Homo sapiens
  Payload ID: 9285
  Gene Symbol: LRRC20
  Gene Name: leucine rich repeat containing 20
  ENSP ID: ENSP00000413745
MLKKMGEAVARVARKVNETVESGSDTLDLAECKLVSFPIGIYKVLRNVSGQIHLITLANNELKSLTSKFMTTFSQLRELHLEGNFLHRLPSEVSALQHLKAIDLSRNQFQDFPEQLTALPALETINLEENEIVDVPVEKLAAMPALRSINLRFNPLNAEVRVIAPPLIKFDMLM

SEQ ID NO: 45528 - protein, 343 aa, Homo sapiens
  Payload ID: 9286
  Gene Symbol: LRRC23
  Gene Name: leucine rich repeat containing 23
  Uniprot ID: Q53EV4
  ENSP ID: ENSP00000007969
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLRYVDISENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLAQNMLKKVEGLEDLSNLTTLHLRDNQIDTLSGFSREMKSLQYLNLRGNMVANLGELAKLRDLPKLRALVLLDNPCTDETSYRQEALVQMPYLERLDKEFYEEEERAEADVIRQRLKEEKEQEPEPQRDLEPEQSLI

SEQ ID NO: 45529 - protein, 312 aa, Homo sapiens
  Payload ID: 9286
  Gene Symbol: LRRC23
  Gene Name: leucine rich repeat containing 23
  Uniprot ID: Q53EV4
  ENSP ID: ENSP00000317464
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLRYVDISENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLAQNMLKKVEGLEDLSNLTTLHLRDNQIDTLSGFSREMKSLQYLNLRRSKTLAFRPDQTPRGSHHMYDREQRMPVFAPKLEIHHNLRPRICSVPVLWAVWGAEWGA

SEQ ID NO: 45530 - protein, 343 aa, Homo sapiens; identical to SEQ ID NO: 45528
  Payload ID: 9286
  Gene Symbol: LRRC23
  Gene Name: leucine rich repeat containing 23
  Uniprot ID: Q53EV4
  ENSP ID: ENSP00000390932

SEQ ID NO: 45531 - protein, 62 aa, Homo sapiens
  Payload ID: 9286
  Gene Symbol: LRRC23
  Gene Name: leucine rich repeat containing 23
  ENSP ID: ENSP00000392623
MSDEDDLEDSEPDQDDSEKEEDEKETEEGEDYRKEGEEFPEEGPDRHLLAALLHPSALCGYF

SEQ ID NO: 45532 - protein, 62 aa, Homo sapiens; identical to SEQ ID NO: 45531
  Payload ID: 9286
  Gene Symbol: LRRC23
  Gene Name: leucine rich repeat containing 23
  ENSP ID: ENSP00000394566

SEQ ID NO: 45533 - protein, 216 aa, Homo sapiens
  Payload ID: 9286
  Gene Symbol: LRRC23
  Gene Name: leucine rich repeat containing 23
  ENSP ID: ENSP00000396049
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLRYVDISENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLEIKDAGLQT

SEQ ID NO: 45534 - protein, 202 aa, Homo sapiens
  Payload ID: 9286
  Gene Symbol: LRRC23
  Gene Name: leucine rich repeat containing 23
  ENSP ID: ENSP00000397192
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLRYVDISENHLTDLSPLNYLTHLLWLKADGNRLRSAQMNELPYLQIASFAYNQITDTEGISHPRLETLNLKGDQRRWPSDLIRLPGAATTCMTENRGCLFLPQSWKFITT

SEQ ID NO: 45535 - protein, 230 aa, Homo sapiens
  Payload ID: 9286
  Gene Symbol: LRRC23
  Gene Name: leucine rich repeat containing 23
  ENSP ID: ENSP00000402554
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLRYVDISENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLVAHWVRGWCREEGTVLGVRMPAF

SEQ ID NO: 45536 - protein, 94 aa, Homo sapiens
  Payload ID: 9286
  Gene Symbol: LRRC23
  Gene Name: leucine rich repeat containing 23
  ENSP ID: ENSP00000408066
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLR

SEQ ID NO: 45537 - protein, 62 aa, Homo sapiens; identical to SEQ ID NO: 45531
  Payload ID: 9286
  Gene Symbol: LRRC23
  Gene Name: leucine rich repeat containing 23
  ENSP ID: ENSP00000412744

SEQ ID NO: 45538 - protein, 202 aa, Homo sapiens; identical to SEQ ID NO: 45534
  Payload ID: 9286
  Gene Symbol: LRRC23
  Gene Name: leucine rich repeat containing 23
  ENSP ID: ENSP00000479128

SEQ ID NO: 45539 - protein, 513 aa, Homo sapiens
  Payload ID: 9287
  Gene Symbol: LRRC24
  Gene Name: leucine rich repeat containing 24
  Uniprot ID: Q50LG9
  ENSP ID: ENSP00000434849
MALRAPALLPLLLLLLPLRAAGCPAACRCYSATVECGALRLRVVPLGIPPGTQTLFLQDNNIARLEPGALAPLAALRRLYLHNNSLRALEAGAFRAQPRLLELALTSNRLRGLRSGAFVGLAQLRVLYLAGNQLARLLDFTFLHLPRLQELHLQENSIELLEDQALAGLSSLALLDLSRNQLGTISREALQPLASLQVLRLTENPWRCDCALHWLGAWIKEGGQRLLTSRDRKIMCAEPPRLALQSLLDVSHSSLICIPPSVHVQPLELTANLGEDLRVACQASGYPQPLVTWRKVPQPREGRPRAQAQLEGGLLGLGGHSASDTGSGMLFLSNITLAHAGKYECEASNAGGAARVPFRLLVNASRQQPQQPAQPPPPAARPAGSEPRPEAGSMAFRALGVATQTAIAAAIALLALTALLLVAMICRRRRRRKKARGPPGEGALFVNDYLDGPCTFAQLEELRDERGHEMFVINRSKPLFAEGPAEAPADCGPEQGAGPGLRVPPPVAYEIHC

SEQ ID NO: 45540 - protein, 510 aa, Homo sapiens
  Payload ID: 9287
  Gene Symbol: LRRC24
  Gene Name: leucine rich repeat containing 24
  ENSP ID: ENSP00000435653
MALRAPALLPLLLLLLPLRAAGCPAACRCYSATVECGALRLRVVPLGIPPGTQTLFLQDNNIARLEPGALAPLAALRRLYLHNNSLRALEAGAFRAQPRLLELALTSNRLRGLRSGAFVGLAQLRVLYLAGNQLARLLDFTFLHLPELHLQENSIELLEDQALAGLSSLALLDLSRNQLGTISREALQPLASLQVLRLTENPWRCDCALHWLGAWIKEGGQRLLTSRDRKIMCAEPPRLALQSLLDVSHSSLICIPPSVHVQPLELTANLGEDLRVACQASGYPQPLVTWRKVPQPREGRPRAQAQLEGGLLGLGGHSASDTGSGMLFLSNITLAHAGKYECEASNAGGAARVPFRLLVNASRQQPQQPAQPPPPAARPAGSEPRPEAGSMAFRALGVATQTAIAAAIALLALTALLLVAMICRRRRRRKKARGPPGEGALFVNDYLDGPCTFAQLEELRDERGHEMFVINRSKPLFAEGPAEAPADCGPEQGAGPGLRVPPPVAYEIHC

SEQ ID NO: 45541 - protein, 305 aa, Homo sapiens
  Payload ID: 9288
  Gene Symbol: LRRC25
  Gene Name: leucine rich repeat containing 25
  Uniprot ID: Q8N386
  ENSP ID: ENSP00000340983
MGGTLAWTLLLPLLLRESDSLEPSCTVSSADVDWNAEFSATCLNFSGLSLSLPHNQSLRASNVILLDLSGNGLRELPVTFFAHLQKLEVLNVLRNPLSRVDGALAARCDLDLQADCNCALESWHDIRRDNCSGQKPLLCWDTTSSQHNLSAFLEVSCAPGLASATIGAVVVSGCLLLGLAIAGPVLAWRLWRCRVARSRELNKPWAAQDGPKPGLGLQPRYGSRSAPKPQVAVPSCPSTPDYENMFVGQPAAEHQWDEQGAHPSEDNDFYINYKDIDLASQPVYCNLQSLGQAPMDEEEYVIPGH

SEQ ID NO: 45542 - protein, 305 aa, Homo sapiens; identical to SEQ ID NO: 45541
  Payload ID: 9288
  Gene Symbol: LRRC25
  Gene Name: leucine rich repeat containing 25
  Uniprot ID: Q8N386
  ENSP ID: ENSP00000472290

SEQ ID NO: 45543 - protein, 334 aa, Homo sapiens
  Payload ID: 9289
  Gene Symbol: LRRC26
  Gene Name: leucine rich repeat containing 26
  Uniprot ID: Q2I0M4
  ENSP ID: ENSP00000360597
MRGPSWSRPRPLLLLLLLLSPWPVWAQVSATASPSGSLGAPDCPEVCTCVPGGLASCSALSLPAVPPGLSLRLRALLLDHNRVRALPPGAFAGAGALQRLDLRENGLHSVHVRAFWGLGALQLLDLSANQLEALAPGTFAPLRALRNLSLAGNRLARLEPAALGALPLLRSLSLQDNELAALAPGLLGRLPALDALHLRGNPWGCGCALRPLCAWLRRHPLPASEAETVLCVWPGRLTLSPLTAFSDAAFSHCAQPLALRDLAVVYTLGPASFLVSLASCLALGSGLTACRARRRRLRTAALRPPRPPDPNPDPDPHGCASPADPGSPAAAAQA

SEQ ID NO: 45544 - protein, 383 aa, Homo sapiens
  Payload ID: 9290
  Gene Symbol: LRRC27
  Gene Name: leucine rich repeat containing 27
  Uniprot ID: Q9C0I9
  ENSP ID: ENSP00000342641
MEGSSSYEVPSVAAADLEEGAGQTRSLPATPSKDVHKGVGGIIFSSSPILDLSESGLCRLEEVFRIPSLQQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRTRVPRKQALQRLHERKTRIMGVVGRAPTHMGEGRQPPPGASYPTSCHRTKWRSEQKDWKRAERRRSESSRRSRL

SEQ ID NO: 45545 - protein, 468 aa, Homo sapiens
  Payload ID: 9290
  Gene Symbol: LRRC27
  Gene Name: leucine rich repeat containing 27
  Uniprot ID: Q9C0I9
  ENSP ID: ENSP00000357601
MDINTYNNQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRRKTASSRSILPDLLSPYQMAIRAKRLEESRAAALRELQEKQALMEQQRREKRALQEWRERAQRMRKRKEELSKLLPPRRSMVASKIPSATDLIDNRKVPLNPPGKMKPSKEKSPQASKEMSALQERNLEEKIKQHVLQMREQRRFHGQAPLEEMRKAAEDLEIATELQDEVLKLKLGLTLNKDRRRAALTGNLSLGLPAAQPQNTFFNTKYGESGNVRRYQ

SEQ ID NO: 45546 - protein, 530 aa, Homo sapiens
  Payload ID: 9290
  Gene Symbol: LRRC27
  Gene Name: leucine rich repeat containing 27
  Uniprot ID: Q9C0I9
  ENSP ID: ENSP00000357602
MEGSSSYEVPSVAAADLEEGAGQTRSLPATPSKDVHKGVGGIIFSSSPILDLSESGLCRLEEVFRIPSLQQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRRKTASSRSILPDLLSPYQMAIRAKRLEESRAAALRELQEKQALMEQQRREKRALQEWRERAQRMRKRKEELSKLLPPRRSMVASKIPSATDLIDNRKVPLNPPGKMKPSKEKSPQASKEMSALQERNLEEKIKQHVLQMREQRRFHGQAPLEEMRKAAEDLEIATELQDEVLKLKLGLTLNKDRRRAALTGNLSLGLPAAQPQNTFFNTKYGESGNVRRYQ

SEQ ID NO: 45547 - protein, 530 aa, Homo sapiens; identical to SEQ ID NO: 45546
  Payload ID: 9290
  Gene Symbol: LRRC27
  Gene Name: leucine rich repeat containing 27
  Uniprot ID: Q9C0I9
  ENSP ID: ENSP00000357603

SEQ ID NO: 45548 - protein, 383 aa, Homo sapiens
  Payload ID: 9290
  Gene Symbol: LRRC27
  Gene Name: leucine rich repeat containing 27
  Uniprot ID: Q9C0I9
  ENSP ID: ENSP00000486582
MEGSSSYEVPSVAAADLEEGAGQTRSLPATPSKDVHKGVGGIIFSSSPILDLSESGLCRLEEVFRIPSLQQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRRKTASSRSILPDLLSPYQMAIRAKRLEESRAAALRELQEKQALMEQQRRPFLLIFPRVFQALTRSSGRFILVLL

SEQ ID NO: 45549 - protein, 367 aa, Homo sapiens
  Payload ID: 9291
  Gene Symbol: LRRC28
  Gene Name: leucine rich repeat containing 28
  Uniprot ID: Q86X40
  ENSP ID: ENSP00000304923
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWKTTVSFVAYCCSTQCLQTFDLLS

SEQ ID NO: 45550 - protein, 93 aa, Homo sapiens
  Payload ID: 9291
  Gene Symbol: LRRC28
  Gene Name: leucine rich repeat containing 28
  ENSP ID: ENSP00000332035
MASELCKTISVARLEKHKNLFLNYRNLHHFPLELLKDEGLQYLERLYMKRNSLTSLPENLAQKLPNLVELKTTVSFVAYCCSTQCLQTFDLLS

SEQ ID NO: 45551 - protein, 312 aa, Homo sapiens
  Payload ID: 9291
  Gene Symbol: LRRC28
  Gene Name: leucine rich repeat containing 28
  Uniprot ID: Q86X40
  ENSP ID: ENSP00000404520
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKGRQLLVLWLTAAPPSVCRLLTC

SEQ ID NO: 45552 - protein, 74 aa, Homo sapiens
  Payload ID: 9291
  Gene Symbol: LRRC28
  Gene Name: leucine rich repeat containing 28
  ENSP ID: ENSP00000452709
MASELCKTISVARLEKHKNLFLNYRNLHHFPLELLKDEGLQYLERLYMKRNSLTSLPENLAQKLPNLVELWNLN

SEQ ID NO: 45553 - protein, 170 aa, Homo sapiens
  Payload ID: 9291
  Gene Symbol: LRRC28
  Gene Name: leucine rich repeat containing 28
  ENSP ID: ENSP00000452785
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLW

SEQ ID NO: 45554 - protein, 300 aa, Homo sapiens
  Payload ID: 9291
  Gene Symbol: LRRC28
  Gene Name: leucine rich repeat containing 28
  ENSP ID: ENSP00000452863
MGYIQSWRPNFPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWK

SEQ ID NO: 45555 - protein, 60 aa, Homo sapiens
  Payload ID: 9291
  Gene Symbol: LRRC28
  Gene Name: leucine rich repeat containing 28
  ENSP ID: ENSP00000452927
MASELCKTISVARLEKHKNLFLNYRNLHHFPLELLKDEGLQYLERLYMKRNSLTSLRLAI

SEQ ID NO: 45556 - protein, 60 aa, Homo sapiens
  Payload ID: 9291
  Gene Symbol: LRRC28
  Gene Name: leucine rich repeat containing 28
  ENSP ID: ENSP00000453313
MASELCKTISVARLEKHKNLFLNYRNLHHFPLELLKDEGLQYLERLYMKRNSLTSLEDNC

SEQ ID NO: 45557 - protein, 61 aa, Homo sapiens
  Payload ID: 9291
  Gene Symbol: LRRC28
  Gene Name: leucine rich repeat containing 28
  ENSP ID: ENSP00000453469
MASELCKTISVARLEKHKNLFLNYRNLHHFPLELLKDEGLQYLERLYMKRNSLTSLIPALK

SEQ ID NO: 45558 - protein, 185 aa, Homo sapiens
  Payload ID: 9291
  Gene Symbol: LRRC28
  Gene Name: leucine rich repeat containing 28
  ENSP ID: ENSP00000453504
MASELCKTISVARLEKHKNLFLNYRNLHHFPLELLKDEGLQYLERLYMKRNSLTSLYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLL

SEQ ID NO: 45559 - protein, 37 aa, Homo sapiens
  Payload ID: 9291
  Gene Symbol: LRRC28
  Gene Name: leucine rich repeat containing 28
  ENSP ID: ENSP00000454182
FPLRETPMAGLHQWKTTVSFVAYCCSTQCLQTFDLLS

SEQ ID NO: 45560 - protein, 223 aa, Homo sapiens
  Payload ID: 9292
  Gene Symbol: LRRC29
  Gene Name: leucine rich repeat containing 29
  Uniprot ID: Q8WV35
  ENSP ID: ENSP00000377561
MYSSGWPAGAAEPRHGRGRELAQALGCMHGAPSQLASLSLAHCSSLKSRPELEHQASGTKDACPEPQGPSLLTLRALQELDLTACSKLTDASLAKVLQFLQLRQLSLSLLPELTDNGLVAVARGCPSLEHLALSHCSRLSDKGWAQAASSWPRLQHLNLSSCSQLIEQTLDAIGQACRQLRVLDVATCPGINMAAVRRFQAQLPQVSCVQSRFVGGADLTLTL

SEQ ID NO: 45561 - protein, 223 aa, Homo sapiens; identical to SEQ ID NO: 45560
  Payload ID: 9292
  Gene Symbol: LRRC29
  Gene Name: leucine rich repeat containing 29
  Uniprot ID: Q8WV35
  ENSP ID: ENSP00000386622

SEQ ID NO: 45562 - protein, 223 aa, Homo sapiens; identical to SEQ ID NO: 45560
  Payload ID: 9292
  Gene Symbol: LRRC29
  Gene Name: leucine rich repeat containing 29
  Uniprot ID: Q8WV35
  ENSP ID: ENSP00000387318

SEQ ID NO: 45563 - protein, 165 aa, Homo sapiens
  Payload ID: 9292
  Gene Symbol: LRRC29
  Gene Name: leucine rich repeat containing 29
  ENSP ID: ENSP00000409459
MYSSGWPAGAAEPRHGRGRELAQALGCMHGAPSQLASLSLAHCSSLKSRPELEHQASGTKDACPEPQGPSLLTLRALQELDLTACSKLTDASLAKVLQFLQLRQLSLSLLPELTDNGLVAVARGCPSLEHLALSHCSRLSDKGWAQAASSWPRLQHLNLSSCSQL

SEQ ID NO: 45564 - protein, 161 aa, Homo sapiens
  Payload ID: 9292
  Gene Symbol: LRRC29
  Gene Name: leucine rich repeat containing 29
  ENSP ID: ENSP00000413129
MYSSGWPAGAAEPRHGRGRELAQALGCMHGAPSQLASLSLAHCSSLKVLQFLQLRQLSLSLLPELTDNGLVAVARGCPSLEHLALSHCSRLSDKGWAQAASSWPRLQHLNLSSCSQLIEQTLDAIGQACRQLRVLDVATCPGINMAAVRRFQAQLPQVSCV

SEQ ID NO: 45565 - protein, 182 aa, Homo sapiens
  Payload ID: 9292
  Gene Symbol: LRRC29
  Gene Name: leucine rich repeat containing 29
  ENSP ID: ENSP00000414023
MYSSGWPAGAAEPRHGRGRELAQALGCMHGAPSQLASLSLAHCSSLKDASVLSMIPALGLSLRVLDLSSCVALTNRTLQAICTYLTHLSVLRLAWCRELCDWGLRGLGEPVQGTQVWDPRGLGGRGGPWDQLPSCPSQVSVGVFKGKLRRNLRSKGFFPQSRPELEHQASGTKDACPEPQGP

SEQ ID NO: 45566 - protein, 223 aa, Homo sapiens; identical to SEQ ID NO: 45560
  Payload ID: 9292
  Gene Symbol: LRRC29
  Gene Name: leucine rich repeat containing 29
  Uniprot ID: Q8WV35
  ENSP ID: ENSP00000486223

SEQ ID NO: 45567 - protein, 257 aa, Homo sapiens
  Payload ID: 9293
  Gene Symbol: LRRC3
  Gene Name: leucine rich repeat containing 3
  Uniprot ID: Q9BY71
  ENSP ID: ENSP00000291592
MGTVRPPRPSLLLVSTRESCLFLLFCLHLGAACPQPCRCPDHAGAVAVFCSLRGLQEVPEDIPANTVLLKLDANKISHLPDGAFQHLHRLRELDLSHNAIEAIGSATFAGLAGGLRLLDLSYNRIQRIPKDALGKLSAKIRLSHNPLHCECALQEALWELKLDPDSVDEIACHTSVQEEFVGKPLVQALDAGASLCSVPHRTTDVAMLVTMFGWFAMVIAYVVYYVRHNQEDARRHLEYLKSLPSAPASKDPIGPGP

SEQ ID NO: 45568 - protein, 301 aa, Homo sapiens
  Payload ID: 9294
  Gene Symbol: LRRC30
  Gene Name: leucine rich repeat containing 30
  Uniprot ID: A6NM36
  ENSP ID: ENSP00000372959
MGARQSRASSKDKGPKRMLFTGRRQKFSPWDDALLSGRDPRSLLKRGMHHVSFSLVTRGMTDIPDFLWGLSEVQKLNLSHNQLRVLPPEVGKLTRIVVLNLCGNRLKSLPREVSLLQCLKVLFVNMNCLTEVPAELSLCRKLEVLSLSHNCLSQLPACFADLSRLRKLNLSNNFFAHIPMCVFSLKELIFLHVGSNRLENIAESIQHLASLQIFIAEGNNIHSFPRSLCLVTSLELLNLNNNDIQTLPSELHLLCRLVRIAWNPMDKGLHISHNPLSKPLPELVEGGLEMLFGYLKDKKHT

SEQ ID NO: 45569 - protein, 496 aa, Homo sapiens
  Payload ID: 9295
  Gene Symbol: LRRC31
  Gene Name: leucine rich repeat containing 31
  Uniprot ID: Q6UY01
  ENSP ID: ENSP00000264676
MSQTRKKTSSEGETKPQTSTVNKFLRGSNAESRKEDNDLKTSDSQPSDWIQKTATSETAKPLSSEMEWRSSMEKNEHFLQKLGKKAVNKCLDLNNCGLTTADMKEMGEAFEMIPELEELNLSWNSKVGGNLPLILQKFQKGSKIQMIELVDCSLTSEDGTFLGQLLPMLQSLEVLDLSINRDIVGSLNSIAQGLKSTSNLKVLKLHSCGLSQKSVKILDAAFRYLGELRKLDLSCNKDLGGGFEDSPAQLVMLKHLQVLDLHQCSLTADDVMSLTQVIPLLSNLQELDLSANKKMGSSSENLLSRLRFLPALKSLVINNCALESETFTALAEASVHLSALEVFNLSWNKCVGGNLKLLLETLKLSMSLQVLRLSSCSLVTEDVALLASVIQTGHLAKLQKLDLSYNDSICDAGWTMFCQNVRFLKELIELDISLRPSNFRDCGQWFRHLLYAVTKLPQITEIGMKRWILPASQEEELECFDQDKKRSIHFDHGGFQ

SEQ ID NO: 45570 - protein, 552 aa, Homo sapiens
  Payload ID: 9295
  Gene Symbol: LRRC31
  Gene Name: leucine rich repeat containing 31
  Uniprot ID: Q6UY01
  ENSP ID: ENSP00000325978
MSQTRKKTSSEGETKPQTSTVNKFLRGSNAESRKEDNDLKTSDSQPSDWIQKTATSETAKPLSSEMEWRSSMEKNEHFLQKLGKKAVNKCLDLNNCGLTTADMKEMVALLPFLPDLEELDISWNGFVGGTLLSITQQMHLVSKLKILRLGSCRLTTDDVQALGEAFEMIPELEELNLSWNSKVGGNLPLILQKFQKGSKIQMIELVDCSLTSEDGTFLGQLLPMLQSLEVLDLSINRDIVGSLNSIAQGLKSTSNLKVLKLHSCGLSQKSVKILDAAFRYLGELRKLDLSCNKDLGGGFEDSPAQLVMLKHLQVLDLHQCSLTADDVMSLTQVIPLLSNLQELDLSANKKMGSSSENLLSRLRFLPALKSLVINNCALESETFTALAEASVHLSALEVFNLSWNKCVGGNLKLLLETLKLSMSLQVLRLSSCSLVTEDVALLASVIQTGHLAKLQKLDLSYNDSICDAGWTMFCQNVRFLKELIELDISLRPSNFRDCGQWFRHLLYAVTKLPQITEIGMKRWILPASQEEELECFDQDKKRSIHFDHGGFQ

SEQ ID NO: 45571 - protein, 443 aa, Homo sapiens
  Payload ID: 9295
  Gene Symbol: LRRC31
  Gene Name: leucine rich repeat containing 31
  Uniprot ID: Q6UY01
  ENSP ID: ENSP00000429145
MSQTRKKTSSEGETKPQTSTVNKFLRGSNAESRKEDNDLKTSDSQPSDWIQKTATSETAKPLSSEMEWRSSMEKNEHFLQKLGKKAVNKCLDLNNCGLTTADMKEMVALLPFLPDLEELDISWNGFVGGTLLSITQQMHLVSKLKILRLGSCRLTTDDVQALGEAFEMIPELEELNLSWNSKVGGNLPLILQKFQKGSKIQMIELVDCSLTSEDGTFLGQLLPMLQSLEVLDLSINRDIVGSLNSIAQGLKSTSNLKVLKLHSCGLSQKSVKILDAAFRYLGELRKLDLSCNKDLGGGFEDSPAQLVMLKHLQVLDLHQCSLTADDVMSLTQVIPLLSNLQELDLSANKKMGSSSENLLSRLRFLPALKSLVINNCALESETFTALAEASVHLSALEVFNLSWNKCVGGNLKLLLETLKLSMSLQVLRLSSCSLVTEDVALLE

SEQ ID NO: 45572 - protein, 662 aa, Homo sapiens
  Payload ID: 9296
  Gene Symbol: LRRC32
  Gene Name: leucine rich repeat containing 32
  Uniprot ID: Q14392
  ENSP ID: ENSP00000260061
MRPQILLLLALLTLGLAAQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPRLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSAPSGNASGRPLSQLLNLDLSYNEIELIPDSFLEHLTSLCFLNLSRNCLRTFEARRLGSLPCLMLLDLSHNALETLELGARALGSLRTLLLQGNALRDLPPYTFANLASLQRLNLQGNRVSPCGGPDEPGPSGCVAFSGITSLRSLSLVDNEIELLRAGAFLHTPLTELDLSSNPGLEVATGALGGLEASLEVLALQGNGLMVLQVDLPCFICLKRLNLAENRLSHLPAWTQAVSLEVLDLRNNSFSLLPGSAMGGLETSLRRLYLQGNPLSCCGNGWLAAQLHQGRVDVDATQDLICRFSSQEEVSLSHVRPEDCEKGGLKNINLIIILTFILVSAILLTTLAACCCVRRQKFNQQYKA

SEQ ID NO: 45573 - protein, 662 aa, Homo sapiens; identical to SEQ ID NO: 45572
  Payload ID: 9296
  Gene Symbol: LRRC32
  Gene Name: leucine rich repeat containing 32
  Uniprot ID: Q14392
  ENSP ID: ENSP00000384126

SEQ ID NO: 45574 - protein, 662 aa, Homo sapiens; identical to SEQ ID NO: 45572
  Payload ID: 9296
  Gene Symbol: LRRC32
  Gene Name: leucine rich repeat containing 32
  Uniprot ID: Q14392
  ENSP ID: ENSP00000385766

SEQ ID NO: 45575 - protein, 186 aa, Homo sapiens
  Payload ID: 9296
  Gene Symbol: LRRC32
  Gene Name: leucine rich repeat containing 32
  ENSP ID: ENSP00000413331
MRPQILLLLALLTLGLAAQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLM

SEQ ID NO: 45576 - protein, 464 aa, Homo sapiens
  Payload ID: 9297
  Gene Symbol: LRRC34
  Gene Name: leucine rich repeat containing 34
  Uniprot ID: Q8IZ02
  ENSP ID: ENSP00000414635
MAAQPPRPVGERSMGSSREAARAPARSPAWASTQASTPGAALAVQRESPESGLQKHYSNLCMEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLGMQSVIAFATVLTQNQAIKAINLNRPILYSEQEESTVHVGRMLKENHCLVALHMCKHDIKNSGIQQLCDALYLNSSLRYLDVSCNKITHDGMVYLADVLKSNTTLEVIDLSFNRIENAGANYLSETLTSHNRSLKALSVVSNNIEGEGLVALSQSMKTNLTFSHIYIWGNKFDEATCIAYSDLIQMGCLKPDNTDVEPFVVDGRVYLAEVSNGLKKHYYWTSTYGESYDHSSNAGFALVPVGQQP

SEQ ID NO: 45577 - protein, 432 aa, Homo sapiens
  Payload ID: 9297
  Gene Symbol: LRRC34
  Gene Name: leucine rich repeat containing 34
  Uniprot ID: Q8IZ02
  ENSP ID: ENSP00000429278
MAAQPPRPVGERSMGSSREAARAPARSPAWASTQASTPGAALAVQRESPESGLQKHYSNLCMEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLEESTVHVGRMLKENHCLVALHMCKHDIKNSGIQQLCDALYLNSSLRYLDVSCNKITHDGMVYLADVLKSNTTLEVIDLSFNRIENAGANYLSETLTSHNRSLKALSVVSNNIEGEGLVALSQSMKTNLTFSHIYIWGNKFDEATCIAYSDLIQMGCLKPDNTDVEPFVVDGRVYLAEVSNGLKKHYYWTSTYGESYDHSSNAGFALVPVGQQP

SEQ ID NO: 45578 - protein, 403 aa, Homo sapiens
  Payload ID: 9297
  Gene Symbol: LRRC34
  Gene Name: leucine rich repeat containing 34
  ENSP ID: ENSP00000429593
MEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLGMQSVIAFATVLTQNQAIKAINLNRPILYSEQEESTVHVGRMLKENHCLVALHMCKHDIKNSGIQQLCDALYLNSSLRYLDVSCNKITHDGMVYLADVLKSNTTLEVIDLSFNRIENAGANYLSETLTSHNRSLKALSVVSNNIEGEGLVALSQSMKTNLTFSHIYIWGNKFDEATCIAYSDLIQMGCLKPDNTDVEPFVVDGRVYLAEVSNGLKKHYYWTSTYGESYDHSSNAGFALVPVGQQP

SEQ ID NO: 45579 - protein, 56 aa, Homo sapiens
  Payload ID: 9297
  Gene Symbol: LRRC34
  Gene Name: leucine rich repeat containing 34
  ENSP ID: ENSP00000436883
EESTVHVGRMLKENHCLVALHMCKHDIKNSGIQQLCDALYLNSSLRYLDVSWHIQT

SEQ ID NO: 45580 - protein, 754 aa, Homo sapiens
  Payload ID: 9298
  Gene Symbol: LRRC36
  Gene Name: leucine rich repeat containing 36
  Uniprot ID: Q1X8D7
  ENSP ID: ENSP00000329943
MAEQWELDEEGIRRLGALTLEQPELVESLSLQGSYAGKIHSIGDAFRNFKNLRSLDLSRNLITSLKGIQYLCSLQDLNLYYNNIPSLVEVSRLQPLPFLKELDLRLNPVVRKDTDYRLFAVYTLQTLEKLDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQTQEVARREMPSDNHQEDEFRHYSPRQSTVRSPEKMTREGYQVSFLDNKSSGSSPEKELIPKPDTFHLTHDASLSKCLDVGDSSQIHPYQLPSDVGLENYDSCYSQTLSLHGSLGKRPQRSKNYQEYSIKPSNDIKTTASHSCGDLLTSLSNPDSSTGRLLKLSSDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEPLSSDLGSLHGLAGNHSPPISARTPHVATVLRQLLELVDKHWNGSGSLLLNKKFLGPARDLLLSLVVPAPSQPRCCSHPEDTMKAFCRRELELKEAAQLVPNDMESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 45581 - protein, 529 aa, Homo sapiens
  Payload ID: 9298
  Gene Symbol: LRRC36
  Gene Name: leucine rich repeat containing 36
  Uniprot ID: Q1X8D7
  ENSP ID: ENSP00000411122
MLRPRFLPPDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQTQEVARREMPSDNHQEDEFRHYSPRQSTVRSPEKMTREGYQVSFLDNKSSGSSPEKELIPKPDTFHLTHDASLSKCLDVGDSSQIHPYQLPSDVGLENYDSCYSQTLSLHGSLGKRPQRSKNYQEYSIKPSNDIKTTASHSCGDLLTSLSNPDSSTGRLLKLSSDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 45582 - protein, 22 aa, Homo sapiens
  Payload ID: 9298
  Gene Symbol: LRRC36
  Gene Name: leucine rich repeat containing 36
  ENSP ID: ENSP00000454309
MLRPRFLPPDDRTVREALGRRQ

SEQ ID NO: 45583 - protein, 38 aa, Homo sapiens
  Payload ID: 9298
  Gene Symbol: LRRC36
  Gene Name: leucine rich repeat containing 36
  ENSP ID: ENSP00000454794
MAEQWELDEEGIRRLGALTLEQPGNPVFMFTPRPEFIL

SEQ ID NO: 45584 - protein, 130 aa, Homo sapiens
  Payload ID: 9298
  Gene Symbol: LRRC36
  Gene Name: leucine rich repeat containing 36
  ENSP ID: ENSP00000455018
MLRPRFLPPDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQICMPQPISTVTLLYLSM

SEQ ID NO: 45585 - protein, 633 aa, Homo sapiens
  Payload ID: 9298
  Gene Symbol: LRRC36
  Gene Name: leucine rich repeat containing 36
  Uniprot ID: Q1X8D7
  ENSP ID: ENSP00000455103
MLRPRFLPPDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQTQEVARREMPSDNHQEDEFRHYSPRQSTVRSPEKMTREGYQVSFLDNKSSGSSPEKELIPKPDTFHLTHDASLSKCLDVGDSSQIHPYQLPSDVGLENYDSCYSQTLSLHGSLGKRPQRSKNYQEYSIKPSNDIKTTASHSCGDLLTSLSNPDSSTGRLLKLSSDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEPLSSDLGSLHGLAGNHSPPISARTPHVATVLRQLLELVDKHWNGSGSLLLNKKFLGPARDLLLSLVVPAPSQPRCCSHPEDTMKAFCRRELELKEAAQLVPNDMESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 45586 - protein, 22 aa, Homo sapiens
  Payload ID: 9298
  Gene Symbol: LRRC36
  Gene Name: leucine rich repeat containing 36
  ENSP ID: ENSP00000455211
MLRPRFLPPDDRTVREALGRRQ

SEQ ID NO: 45587 - protein, 126 aa, Homo sapiens
  Payload ID: 9298
  Gene Symbol: LRRC36
  Gene Name: leucine rich repeat containing 36
  ENSP ID: ENSP00000455799
MLRPRFLPPDDRTVREGERKAAKLHFSQLGNSENFLLEVEKSSREKTMKNCVTGESSASKVSANVDSRIEMERVLLCRPDWSAVARSRLTATSTSWVQAVLLPQPSEQLGLQTQTKDFLFPSPTGK

SEQ ID NO: 45588 - protein, 74 aa, Homo sapiens
  Payload ID: 9298
  Gene Symbol: LRRC36
  Gene Name: leucine rich repeat containing 36
  ENSP ID: ENSP00000456164
MLRPRFLPPDDRTVREGERKAAKLHFSQLGNSENFLLEVEKSSREKTMKNCVTGESSASKVSANVDSRIEMASL

SEQ ID NO: 45589 - protein, 64 aa, Homo sapiens
  Payload ID: 9298
  Gene Symbol: LRRC36
  Gene Name: leucine rich repeat containing 36
  ENSP ID: ENSP00000456347
MAEQWELDEEGIRRLGALTLEQPDSNKGLFIPFPNREIKDSLSTSATQGNGTRDQKLDTFPLGT

SEQ ID NO: 45590 - protein, 22 aa, Homo sapiens
  Payload ID: 9298
  Gene Symbol: LRRC36
  Gene Name: leucine rich repeat containing 36
  ENSP ID: ENSP00000456517
MLRPRFLPPDDRTVREALGRRQ

SEQ ID NO: 45591 - protein, 83 aa, Homo sapiens
  Payload ID: 9298
  Gene Symbol: LRRC36
  Gene Name: leucine rich repeat containing 36
  ENSP ID: ENSP00000456814
MKNCVTGESSASKVSANVDSRIEMDSNKGLFIPFPNREIKDSLSTSATQGNGTRDQKLDTFPLGTQTQEVARREMPSDNHQED

SEQ ID NO: 45592 - protein, 29 aa, Homo sapiens
  Payload ID: 9298
  Gene Symbol: LRRC36
  Gene Name: leucine rich repeat containing 36
  ENSP ID: ENSP00000464367
MKNCVTGESSASKVSANVDSRIEMDSNKG

SEQ ID NO: 45593 - protein, 275 aa, Homo sapiens
  Payload ID: 9298
  Gene Symbol: LRRC36
  Gene Name: leucine rich repeat containing 36
  ENSP ID: ENSP00000464675
  MOD_RES (1)..(1): Any amino acid
XDEEGIRRLGALTLEQPETGSCYVAQAGLELLDSSNPVSASPVTETTELVESLSLQGSYAGKIHSIGDAFRNFKNLRSLDLSRNLITSLKGIQYLCSLQDLNLYYNNIPSLVEVSRLQPLPFLKELDLRLNPVVRKDTDYRLFAVYTLQTLEKLDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQICMPQPISTVTLLYLSM

SEQ ID NO: 45594 - protein, 1700 aa, Homo sapiens
  Payload ID: 9299
  Gene Symbol: LRRC37A2
  Gene Name: leucine rich repeat containing 37, member A2
  Uniprot ID: A6NM11
  ENSP ID: ENSP00000333071
MSSAQCPALVCVMSRLRFWGPWPLLMWQLLWLLVKEAQPLEWVKDPLQLTSNPLGPPDSWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETRHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIENNNTKHTTARNAFEENDFMENTNMPEGTISENTNYNHPHEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPWRGCSSRRESQDGLSSFGQPLWFKDMYKPLSATRINNHAWKLHKKSSNEDKILNRDPGDSEAPTEEEESEALP

SEQ ID NO: 45595 - protein, 1700 aa, Homo sapiens; identical to SEQ ID NO: 45594
  Payload ID: 9299
  Gene Symbol: LRRC37A2
  Gene Name: leucine rich repeat containing 37, member A2
  Uniprot ID: A6NM11
  ENSP ID: ENSP00000459551

SEQ ID NO: 45596 - protein, 1700 aa, Homo sapiens
  Payload ID: 9299
  Gene Symbol: LRRC37A2
  Gene Name: leucine rich repeat containing 37, member A2
  ENSP ID: ENSP00000481827
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGTHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 45597 - protein, 1700 aa, Homo sapiens
  Payload ID: 9299
  Gene Symbol: LRRC37A2
  Gene Name: leucine rich repeat containing 37, member A2
  ENSP ID: ENSP00000482650
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEATNETESSQAQQETPIQFPEEVEPSATQQEAPIEPPVPPMEHELSISEQQQPVQPSETSREVESSPTQQETPGQPPEHHEVTVSPPGDHQTHHLDSPSVSVKPPDVQLTIAAEPSAEVGTSLVQQEATTRLSGSGNDIEPPAIQHGGPPLLSESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASEIEWDTDQWKIENYINESTEAQSEQKEKSLELKKEVPGYGYTDKLILALIVTGILTILIILFCLIVICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 45598 - protein, 738 aa, Homo sapiens
  Payload ID: 9299
  Gene Symbol: LRRC37A2
  Gene Name: leucine rich repeat containing 37, member A2
  ENSP ID: ENSP00000486567
MQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGTHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 45599 - protein, 1635 aa, Homo sapiens
  Payload ID: 9299
  Gene Symbol: LRRC37A2
  Gene Name: leucine rich repeat containing 37, member A2
  ENSP ID: ENSP00000487340
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGTHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 45600 - protein, 1676 aa, Homo sapiens
  Payload ID: 9299
  Gene Symbol: LRRC37A2
  Gene Name: leucine rich repeat containing 37, member A2
  ENSP ID: ENSP00000487612
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEATNETESSQAQQETPIQFPEEVEPSATQQEAPIEPPVPPMEHELSISEQQQPVQPSETSREVESSPTQQETPGQPPEHHEVTVSPPGDHQTHHLDSPSVSVKPPDVQLTIAAEPSAEVGTSLVQQEATTRLSGSGNDIEPPAIQHGGPPLLSESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASEIEWDTDQWKIENYINESTEAQSEQKEKSLELKKEVPGYGYTDKLILALIVTGILTILIILFCLIVICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 45601 - protein, 738 aa, Homo sapiens
  Payload ID: 9299
  Gene Symbol: LRRC37A2
  Gene Name: leucine rich repeat containing 37, member A2
  ENSP ID: ENSP00000487663
MQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASEIEWDTDQWKIENYINESTEAQSEQKEKSLELKKEVPGYGYTDKLILALIVTGILTILIILFCLIVICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 45602 - protein, 1611 aa, Homo sapiens
  Payload ID: 9299
  Gene Symbol: LRRC37A2
  Gene Name: leucine rich repeat containing 37, member A2
  ENSP ID: ENSP00000488106
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEATNETESSQAQQETPIQFPEEVEPSATQQEAPIEPPVPPMEHELSISEQQQPVQPSETSREVESSPTQQETPGQPPEHHEVTVSPPGDHQTHHLDSPSVSVKPPDVQLTIAAEPSAEVGTSLVQQEATTRLSGSGNDIEPPAIQHGGPPLLSESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASEIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 45603 - protein, 1634 aa, Homo sapiens
  Payload ID: 9300
  Gene Symbol: LRRC37A3
  Gene Name: leucine rich repeat containing 37, member A3
  Uniprot ID: O60309
  ENSP ID: ENSP00000325713
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIHQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESSREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQLPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLIVPSHMACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNYNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKKLILALIVTGILTILIILLCLIEICCHRRSLQEDEEGFSRDSEAPTEEESEALP

SEQ ID NO: 45604 - protein, 611 aa, Homo sapiens
  Payload ID: 9300
  Gene Symbol: LRRC37A3
  Gene Name: leucine rich repeat containing 37, member A3
  ENSP ID: ENSP00000335617
MACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNYNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKKLILALIVTGILTILIILLCLIEICCHRRSLQEDEEGFSRDSEAPTEEESEALP

SEQ ID NO: 45605 - protein, 752 aa, Homo sapiens
  Payload ID: 9300
  Gene Symbol: LRRC37A3
  Gene Name: leucine rich repeat containing 37, member A3
  ENSP ID: ENSP00000344298
MEFHRVAQAGVELLSSGDPPASASQSVGIIGVSHCTWHRNFQGNYISYIDGNVWKAYSWTEKLILRENNLTELHKDSFEGLLSLQYLILNHNPLTTVEDPYLFKLPALKYLDMGTTLVPLTTLKNILMMTVELEKLIVPSHMACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNYNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKKLILALIVTGILTILIILLCLIEICCHRRSLQEDEEGFSRDSEAPTEEESEALP

SEQ ID NO: 45606 - protein, 672 aa, Homo sapiens
  Payload ID: 9300
  Gene Symbol: LRRC37A3
  Gene Name: leucine rich repeat containing 37, member A3
  ENSP ID: ENSP00000383674
MQFLHKLILNHNPLTTVEDPYLFKLPALKYLDMGTTLVPLTTLKNILMMTVELEKLIVPSHMACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNYNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKKLILALIVTGILTILIILLCLIEICCHRRSLQEDEEGFSRDSEAPTEEESEALP

SEQ ID NO: 45607 - protein, 231 aa, Homo sapiens
  Payload ID: 9300
  Gene Symbol: LRRC37A3
  Gene Name: leucine rich repeat containing 37, member A3
  ENSP ID: ENSP00000462864
  MOD_RES (1)..(1): Any amino acid
XALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLIVPSHMACCLCQFKNSIEAVCKTVKLHC

SEQ ID NO: 45608 - protein, 93 aa, Homo sapiens
  Payload ID: 9300
  Gene Symbol: LRRC37A3
  Gene Name: leucine rich repeat containing 37, member A3
  ENSP ID: ENSP00000462872
GAHVQVTCAKLVSRTGHLMKLLSGQQEVKASKIEWDTDQWKTENYINESTEAQSEQKEKSLEICCHRRSLQEDEEGFSRDSEAPTEEESEALP

SEQ ID NO: 45609 - protein, 197 aa, Homo sapiens
  Payload ID: 9300
  Gene Symbol: LRRC37A3
  Gene Name: leucine rich repeat containing 37, member A3
  ENSP ID: ENSP00000463186
  MOD_RES (1)..(1): Any amino acid
XVKPSPTTEETSTQLPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILNHNPLTTVEDPYLFKLPALKYLDMGTTLVPLTTL

SEQ ID NO: 45610 - protein, 236 aa, Homo sapiens
  Payload ID: 9300
  Gene Symbol: LRRC37A3
  Gene Name: leucine rich repeat containing 37, member A3
  ENSP ID: ENSP00000463346
MAAEGDPQNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLIVPSHMACCLCQFKNSIEAVCKTVKLHCNSACLTNTTHCPEEASVGNPEGAFMKVLQARKNYTSTELIIEPEEPSDSSGI

SEQ ID NO: 45611 - protein, 1634 aa, Homo sapiens; identical to SEQ ID NO: 45603
  Payload ID: 9300
  Gene Symbol: LRRC37A3
  Gene Name: leucine rich repeat containing 37, member A3
  Uniprot ID: O60309
  ENSP ID: ENSP00000464535

SEQ ID NO: 45612 - protein, 1700 aa, Homo sapiens
  Payload ID: 9301
  Gene Symbol: LRRC37A
  Gene Name: leucine rich repeat containing 37A
  Uniprot ID: A6NMS7
  ENSP ID: ENSP00000326324
MSSAQCPALVCVMSRLRFWGPWPLLMWQLLWLLVKEAQPLEWVKDPLQLTSNPLGPPESWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLTSPAPREVEQPHTQQGPEKLAGNAVYTKPSFTQEHKAAVSVLKPFSKGTPSTSSPAKALPQVRDRSKDLTHAISILESAKARVTNTKTSKPIVHARKKYRFHKTRSHVTHRTTKVKKSPKVRKKSYLSRLMLANRLPFSAAKSLINSPSQGAFSSLGDLSPQENPFLEVSALSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPWRGCSSRRESQDGLSSFGQPLWFKDLYKPLSATRINNHAWKLHKKSSNEDKILNRDPGDSEAPTEEEESEALP

SEQ ID NO: 45613 - protein, 1635 aa, Homo sapiens
  Payload ID: 9301
  Gene Symbol: LRRC37A
  Gene Name: leucine rich repeat containing 37A
  ENSP ID: ENSP00000377108
MSSAQCPALVCVMSRLRFWGPWPLLMWQLLWLLVKEAQPLEWVKDPLQLTSNPLGPPESWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLTSPAPREVEQPHTQQGPEKLAGNAVYTKPSFTQEHKAAVSVLKPFSKGTPSTSSPAKALPQVRDRSKDLTHAISILESAKARVTNTKTSKPIVHARKKYRFHKTRSHVTHRTTKVKKSPKVRKKSYLSRLMLANRLPFSAAKSLINSPSQGAFSSLGDLSPQENPFLEVSALSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 45614 - protein, 738 aa, Homo sapiens
  Payload ID: 9301
  Gene Symbol: LRRC37A
  Gene Name: leucine rich repeat containing 37A
  ENSP ID: ENSP00000437021
MQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLTSPAPREVEQPHTQQGPEKLAGNAVYTKPSFTQEHKAAVSVLKPFSKGTPSTSSPAKALPQVRDRSKDLTHAISILESAKARVTNTKTSKPIVHARKKYRFHKTRSHVTHRTTKVKKSPKVRKKSYLSRLMLANRLPFSAAKSLINSPSQGAFSSLGDLSPQENPFLEVSALSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPWRGCSSRRESQDGLSSFGQPLWFKDLYKPLSATRINNHAWKLHKKSSNEDKILNRDPGDSEAPTEEEESEALP

SEQ ID NO: 45615 - protein, 1700 aa, Homo sapiens
  Payload ID: 9301
  Gene Symbol: LRRC37A
  Gene Name: leucine rich repeat containing 37A
  ENSP ID: ENSP00000481100
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 45616 - protein, 738 aa, Homo sapiens
  Payload ID: 9301
  Gene Symbol: LRRC37A
  Gene Name: leucine rich repeat containing 37A
  ENSP ID: ENSP00000486192
MQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 45617 - protein, 1635 aa, Homo sapiens
  Payload ID: 9301
  Gene Symbol: LRRC37A
  Gene Name: leucine rich repeat containing 37A
  ENSP ID: ENSP00000486596
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISTLESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 45618 - protein, 974 aa, Homo sapiens
  Payload ID: 9302
  Gene Symbol: LRRC37B
  Gene Name: leucine rich repeat containing 37B
  ENSP ID: ENSP00000332536
MAHAYKGHEHLRAARMAFAECIAPACVMSWLRFWGPWPLLTWQLLSLLVKEAQPLVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 45619 - protein, 947 aa, Homo sapiens
  Payload ID: 9302
  Gene Symbol: LRRC37B
  Gene Name: leucine rich repeat containing 37B
  Uniprot ID: Q96QE4
  ENSP ID: ENSP00000340519
MSWLRFWGPWPLLTWQLLSLLVKEAQPLVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 45620 - protein, 947 aa, Homo sapiens; identical to SEQ ID NO: 45619
  Payload ID: 9302
  Gene Symbol: LRRC37B
  Gene Name: leucine rich repeat containing 37B
  Uniprot ID: Q96QE4
  ENSP ID: ENSP00000378202

SEQ ID NO: 45621 - protein, 865 aa, Homo sapiens
  Payload ID: 9302
  Gene Symbol: LRRC37B
  Gene Name: leucine rich repeat containing 37B
  ENSP ID: ENSP00000443345
MSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 45622 - protein, 908 aa, Homo sapiens
  Payload ID: 9302
  Gene Symbol: LRRC37B
  Gene Name: leucine rich repeat containing 37B
  ENSP ID: ENSP00000463081
MAFAECIAPACVMSWLRFWGPWPLLTWQLLSLLVKEAQPLVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 45623 - protein, 236 aa, Homo sapiens
  Payload ID: 9302
  Gene Symbol: LRRC37B
  Gene Name: leucine rich repeat containing 37B
  ENSP ID: ENSP00000463146
  MOD_RES (1)..(1): Any amino acid
XEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVRTIINSGFQNTILCLCGFRIHKLKTNVTFPLDILLLSFKAEVCFVLLLQCIFQDC

SEQ ID NO: 45624 - protein, 155 aa, Homo sapiens
  Payload ID: 9302
  Gene Symbol: LRRC37B
  Gene Name: leucine rich repeat containing 37B
  ENSP ID: ENSP00000463323
MSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSL

SEQ ID NO: 45625 - protein, 218 aa, Homo sapiens
  Payload ID: 9302
  Gene Symbol: LRRC37B
  Gene Name: leucine rich repeat containing 37B
  ENSP ID: ENSP00000463513
MMTTRARRRSKRRGAAMPRRPRSLRTTRRMTWRRTTMTPIIRRSWKMTTRTPVTPRKAASAALQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGS

SEQ ID NO: 45626 - protein, 720 aa, Homo sapiens
  Payload ID: 9302
  Gene Symbol: LRRC37B
  Gene Name: leucine rich repeat containing 37B
  ENSP ID: ENSP00000463564
MAFAECIAPACVMSWLRFWGPWPLLTWQLLSLLVKEAQPLVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKL

SEQ ID NO: 45627 - protein, 294 aa, Homo sapiens
  Payload ID: 9303
  Gene Symbol: LRRC38
  Gene Name: leucine rich repeat containing 38
  Uniprot ID: Q5VT99
  ENSP ID: ENSP00000365253
MRPRAPACAAAALGLCSLLLLLAPGHACPAGCACTDPHTVDCRDRGLPSVPDPFPLDVRKLLVAGNRIQRIPEDFFIFYGDLVYLDFRNNSLRSLEEGTFSGSAKLVFLDLSYNNLTQLGAGAFRSAGRLVKLSLANNNLVGVHEDAFETLESLQVLELNDNNLRSLSVAALAALPALRSLRLDGNPWLCDCDFAHLFSWIQENASKLPKGLDEIQCSLPMESRRISLRELSEASFSECRFSLSLTDLCIIIFSGVAVSIAAIISSFFLATVVQCLQRCAPNKDAEDEDEDKDD

SEQ ID NO: 45628 - protein, 335 aa, Homo sapiens
  Payload ID: 9304
  Gene Symbol: LRRC39
  Gene Name: leucine rich repeat containing 39
  Uniprot ID: Q96DD0
  ENSP ID: ENSP00000344470
MTENVVCTGAVNAVKEVWEKRIKKLNEDLKREKEFQHKLVRIWEERVSLTKLREKVTREDGRVILKIEKEEWKTLPSSLLKLNQLQEWQLHRTGLLKIPEFIGRFQNLIVLDLSRNTISEIPPGIGLLTRLQELILSYNKIKTVPKELSNCASLEKLELAVNRDICDLPQELSNLLKLTHLDLSMNDFTTIPLAVLNMPALEWLDMGSNKLEQLPDTIERMQNLHTLWLQRNEITCLPQTISNMKNLGTLVLSNNKLQDIPVCMEEMANLRFVNFRDNPLKLKVSLPPSEGTDEEEERELFGLQFMHTYIQESRRRADHQVNGSTTLPISINTDG

SEQ ID NO: 45629 - protein, 335 aa, Homo sapiens; identical to SEQ ID NO: 45628
  Payload ID: 9304
  Gene Symbol: LRRC39
  Gene Name: leucine rich repeat containing 39
  Uniprot ID: Q96DD0
  ENSP ID: ENSP00000359156

SEQ ID NO: 45630 - protein, 339 aa, Homo sapiens
  Payload ID: 9304
  Gene Symbol: LRRC39
  Gene Name: leucine rich repeat containing 39
  Uniprot ID: Q96DD0
  ENSP ID: ENSP00000359157
MTENVVCTGAVNAVKEVWEKRIKKLNEDLKREKEFQHKLVRIWEERVSLTKLREKVTREDGRVILKIEKEEWKTLPSSLLKLNQLQEWQLHRTGLLKIPEFIGRFQNLIVLDLSRNTISEIPPGIGLLTRLQELILSYNKIKTVPKELSNCASLEKLELAVNRDICDLPQELSNLLKLTHLDLSMNDFTTIPLAVLNMPALEWLDMGSNKLEQLPDTIERMQNLHTLWLQRNEITCLPQTISNMKNLGTLVLSNNKLQDIPVCMEEMANLRFVNFRDNPLKLKVSLPPSEGTDEEEERELFGLQFMHTYIQESRRRAALQFCVCHGQILTIYTCMALEI

SEQ ID NO: 45631 - protein, 339 aa, Homo sapiens; identical to SEQ ID NO: 45630
  Payload ID: 9304
  Gene Symbol: LRRC39
  Gene Name: leucine rich repeat containing 39
  Uniprot ID: Q96DD0
  ENSP ID: ENSP00000480740

SEQ ID NO: 45632 - protein, 259 aa, Homo sapiens
  Payload ID: 9305
  Gene Symbol: LRRC3B
  Gene Name: leucine rich repeat containing 3B
  Uniprot ID: Q96PB8
  ENSP ID: ENSP00000379880
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASNHETAHNVICKTSVLDEHAGRPFLNAANDADLCNLPKKTTDYAMLVTMFGWFTMVISYVVYYVRQNQEDARRHLEYLKSLPSRQKKADEPDDISTVV

SEQ ID NO: 45633 - protein, 54 aa, Homo sapiens
  Payload ID: 9305
  Gene Symbol: LRRC3B
  Gene Name: leucine rich repeat containing 3B
  ENSP ID: ENSP00000389764
MNLVDLWLTRSLSMCLLLQSFVLMILCFHSASMCPKGCLCSSSGGLNVTCSNAN

SEQ ID NO: 45634 - protein, 259 aa, Homo sapiens; identical to SEQ ID NO: 45632
  Payload ID: 9305
  Gene Symbol: LRRC3B
  Gene Name: leucine rich repeat containing 3B
  Uniprot ID: Q96PB8
  ENSP ID: ENSP00000394940

SEQ ID NO: 45635 - protein, 163 aa, Homo sapiens
  Payload ID: 9305
  Gene Symbol: LRRC3B
  Gene Name: leucine rich repeat containing 3B
  ENSP ID: ENSP00000398184
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASN

SEQ ID NO: 45636 - protein, 259 aa, Homo sapiens; identical to SEQ ID NO: 45632
  Payload ID: 9305
  Gene Symbol: LRRC3B
  Gene Name: leucine rich repeat containing 3B
  Uniprot ID: Q96PB8
  ENSP ID: ENSP00000406370

SEQ ID NO: 45637 - protein, 275 aa, Homo sapiens
  Payload ID: 9306
  Gene Symbol: LRRC3C
  Gene Name: leucine rich repeat containing 3C
  Uniprot ID: A6NJW4
  ENSP ID: ENSP00000367157
MRMTSSSFVSYCTPGLCQFMAMLPTAGHLLPLLLVIGTGGTVPSPQVPPRGCYVAKEAGERTFRCSQAGLSAVPSGIPNDTRKLYLDANQLASVPAGAFQHLPVLEELDLSHNALAHLSGAAFQGLEGTLRHLDLSANQLASVPVEAFVGLQIQVNLSANPWHCDCALQEVLRQVRLVPGTGTGIVCGSGARPDLVGQEFLLLAGEEELCGSGWGGARRSTDVALLVTMGGWLTLMVAYLVHYVWQNRDETRRSLKRAPVLPVRSEDSSILSTVV

SEQ ID NO: 45638 - protein, 653 aa, Homo sapiens
  Payload ID: 9307
  Gene Symbol: LRRC4
  Gene Name: leucine rich repeat containing 4
  Uniprot ID: Q9HBW1
  ENSP ID: ENSP00000249363
MKLLWQVTVHHHTWNAILLPFVYLTAQVWILCAAIAAAASAGPQNCPSVCSCSNQFSKVVCTRRGLSEVPQGIPSNTRYLNLMENNIQMIQADTFRHLHHLEVLQLGRNSIRQIEVGAFNGLASLNTLELFDNWLTVIPSGAFEYLSKLRELWLRNNPIESIPSYAFNRVPSLMRLDLGELKKLEYISEGAFEGLFNLKYLNLGMCNIKDMPNLTPLVGLEELEMSGNHFPEIRPGSFHGLSSLKKLWVMNSQVSLIERNAFDGLASLVELNLAHNNLSSLPHDLFTPLRYLVELHLHHNPWNCDCDILWLAWWLREYIPTNSTCCGRCHAPMHMRGRYLVEVDQASFQCSAPFIMDAPRDLNISEGRMAELKCRTPPMSSVKWLLPNGTVLSHASRHPRISVLNDGTLNFSHVLLSDTGVYTCMVTNVAGNSNASAYLNVSTAELNTSNYSFFTTVTVETTEISPEDTTRKYKPVPTTSTGYQPAYTTSTTVLIQTTRVPKQVAVPATDTTDKMQTSLDEVMKTTKIIIGCFVAVTLLAAAMLIVFYKLRKRHQQRSTVTAARTVEIIQVDEDIPAATSAAATAAPSGVSGEGAVVLPTIHDHINYNTYKPAHGAHWTENSLGNSLHPTVTTISEPYIIQTHTKDKVQETQI

SEQ ID NO: 45639 - protein, 50 aa, Homo sapiens
  Payload ID: 9307
  Gene Symbol: LRRC4
  Gene Name: leucine rich repeat containing 4
  ENSP ID: ENSP00000417795
MKLLWQVTVHHHTWNAILLPFVYLTAQVWILCAAIAAAASAGPQNCPSVC

SEQ ID NO: 45640 - protein, 94 aa, Homo sapiens
  Payload ID: 9307
  Gene Symbol: LRRC4
  Gene Name: leucine rich repeat containing 4
  ENSP ID: ENSP00000418093
MKLLWQVTVHHHTWNAILLPFVYLTAQVWILCAAIAAAASAGPQNCPSVCSCSNQFSKVVCTRRGLSEVPQGIPSNTRYLNLMENNIQMIQADT

SEQ ID NO: 45641 - protein, 78 aa, Homo sapiens
  Payload ID: 9307
  Gene Symbol: LRRC4
  Gene Name: leucine rich repeat containing 4
  ENSP ID: ENSP00000418254
MENNIQMIQADTFRHLHHLEVLQLGRNSIRQIEVGAFNGLASLNTLELFDNWLTVIPSGAFEYLSKLRELWLRNNPIE

SEQ ID NO: 45642 - protein, 602 aa, Homo sapiens
  Payload ID: 9308
  Gene Symbol: LRRC40
  Gene Name: leucine rich repeat containing 40
  Uniprot ID: Q9H9A6
  ENSP ID: ENSP00000359990
MSRLKRIAGQDLRAGFKAGGRDCGTSVPQGLLKAARKSGQLNLSGRNLSEVPQCVWRINVDIPEEANQNLSFGATERWWEQTDLTKLIISNNKLQSLTDDLRLLPALTVLDIHDNQLTSLPSAIRELENLQKLNVSHNKLKILPEEITNLRNLKCLYLQHNELTCISEGFEQLSNLEDLDLSNNHLTTVPASFSSLSSLVRLNLSSNELKSLPAEINRMKRLKHLDCNSNLLETIPPELAGMESLELLYLRRNKLRFLPEFPSCSLLKELHVGENQIEMLEAEHLKHLNSILVLDLRDNKLKSVPDEIILLRSLERLDLSNNDISSLPYSLGNLHLKFLALEGNPLRTIRREIISKGTQEVLKYLRSKIKDDGPSQSESATETAMTLPSESRVNIHAIITLKILDYSDKQATLIPDEVFDAVKSNIVTSINFSKNQLCEIPKRMVELKEMVSDVDLSFNKLSFISLELCVLQKLTFLDLRNNFLNSLPEEMESLVRLQTINLSFNRFKMLPEVLYRIFTLETILISNNQVGSVDPQKMKMMENLTTLDLQNNDLLQIPPELGNCVNLRTLLLDGNPFRVPRAAILMKGTAAILEYLRDRIPT

SEQ ID NO: 45643 - protein, 812 aa, Homo sapiens
  Payload ID: 9309
  Gene Symbol: LRRC41
  Gene Name: leucine rich repeat containing 41
  Uniprot ID: Q15345
  ENSP ID: ENSP00000343298
MAAPEAWRARSCWFCEVAAATTMEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISSNCIKPDGLLEFAKRLERWGRGAFGHLRLFQNWLDQDAVTAREAIRRLRATCHVVSDSWDSSQAFADYVSTM

SEQ ID NO: 45644 - protein, 812 aa, Homo sapiens; identical to SEQ ID NO: 45643
  Payload ID: 9309
  Gene Symbol: LRRC41
  Gene Name: leucine rich repeat containing 41
  Uniprot ID: Q15345
  ENSP ID: ENSP00000477792

SEQ ID NO: 45645 - protein, 227 aa, Homo sapiens
  Payload ID: 9309
  Gene Symbol: LRRC41
  Gene Name: leucine rich repeat containing 41
  ENSP ID: ENSP00000477909
PPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISWSYTPKDKAGLLSDVANKARFLPRMPELTKCTKLKYSSRSFWMGVPEMSTRRLVFKLSRA

SEQ ID NO: 45646 - protein, 620 aa, Homo sapiens
  Payload ID: 9309
  Gene Symbol: LRRC41
  Gene Name: leucine rich repeat containing 41
  ENSP ID: ENSP00000478135
MKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGGGQTLGRERGKELGL

SEQ ID NO: 45647 - protein, 521 aa, Homo sapiens
  Payload ID: 9309
  Gene Symbol: LRRC41
  Gene Name: leucine rich repeat containing 41
  ENSP ID: ENSP00000483633
MEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGEHPGVAGIGLRLPSSTSCVPNSREVGGANWGYDQEVREEGLYAS

SEQ ID NO: 45648 - protein, 617 aa, Homo sapiens
  Payload ID: 9309
  Gene Symbol: LRRC41
  Gene Name: leucine rich repeat containing 41
  ENSP ID: ENSP00000484558
MSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISSNCIKPDGLLEFAKRLERWGRGAFGHLRLFQNWLDQDAVTAREAIRRLRATCHVVSDSWTHPRPSQIMLAPCDGARTSQSHARYHQLAGAEAWAAQNPNHQFYLSLSVTFFLFFPSSLALRSWRP

SEQ ID NO: 45649 - protein, 790 aa, Homo sapiens
  Payload ID: 9309
  Gene Symbol: LRRC41
  Gene Name: leucine rich repeat containing 41
  ENSP ID: ENSP00000484752
MEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISSNCIKPDGLLEFAKRLERWGRGAFGHLRLFQNWLDQDAVTAREAIRRLRATCHVVSDSWDSSQAFADYVSTM

SEQ ID NO: 45650 - protein, 428 aa, Homo sapiens
  Payload ID: 9310
  Gene Symbol: LRRC42
  Gene Name: leucine rich repeat containing 42
  Uniprot ID: Q9Y546
  ENSP ID: ENSP00000318185
MSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELLEHLTNEALSSVTQLHLKDNCLSDAGVRKMTAPVRVMKRGLENLTLLDLSCNPEITDAGIGYLFSFRKLNCLDISGTGLKDIKTVKHKLQTHIGLVHSKVPLKEFDHSNCKTEGWADQIVLQWERVTAEAVKPRETSEPRAAAQRFYGKRSRAEAPLKCPLADTHMNSSEKLQFYKEKAPDCHGPVLKHEAISSQESKKSKKRPFEESETEQNNSSQPSKQKYVCLAVEDWDLLNSY

SEQ ID NO: 45651 - protein, 192 aa, Homo sapiens
  Payload ID: 9310
  Gene Symbol: LRRC42
  Gene Name: leucine rich repeat containing 42
  ENSP ID: ENSP00000360419
MSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELL

SEQ ID NO: 45652 - protein, 428 aa, Homo sapiens; identical to SEQ ID NO: 45650
  Payload ID: 9310
  Gene Symbol: LRRC42
  Gene Name: leucine rich repeat containing 42
  Uniprot ID: Q9Y546
  ENSP ID: ENSP00000360421

SEQ ID NO: 45653 - protein, 239 aa, Homo sapiens
  Payload ID: 9310
  Gene Symbol: LRRC42
  Gene Name: leucine rich repeat containing 42
  ENSP ID: ENSP00000389368
MSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELLEHLTNEALSSVTQLHLKDNCLSDAGVRKMTAPVRVMKRGLENLTLLD

SEQ ID NO: 45654 - protein, 656 aa, Homo sapiens
  Payload ID: 9311
  Gene Symbol: LRRC43
  Gene Name: leucine rich repeat containing 43
  Uniprot ID: Q8N309
  ENSP ID: ENSP00000344233
MEASYESESESESEAGPGTQRPGTGTVSAAVREHLRKLCLREFPCGAGSWNKSRFLPQTWRTWRELVPREEDVVSPGEETVEALLGLVRSRHSPWALLNNSNAEDSFLRELAIRNPLTITDTFFYSYFRSLRVIDKKVTLVDKDLLKFLKLEELVLSANRIKEVDATNLPPTLKVLELYGNEISSMECLCAHPPAGLQHLGLGHNKLLGPLESLYVTANHWPNLVSLDLGFNDLTDLQSMVTSLRTLRHLRLLVLQGNPLALVPYYRGLTIDSLAQLCVLDDITVSPNEKHLFRGLSLNGDLLAQEAQFVVTIGNIRGVLDTSVLDPEPRPEGPFITYNYYVTYDFVKDEEGEMNESAGVLAEIVKPSPSLELLVEESPEEVVEDVIEDIVEEVTEEVEGSLESEVEESGESELSVISGPSTILQMPRASAEELAKLRLRIDPRLCPSPGTVLFSTAHKPWAEVIPCSYEMQHSLRDLVPLKAFLLAGTTVTIVEEKILSWPVVLPAVDSPLSAKKGKGEKDKKGKEKDRTGKGEKEPAKEWKVLKKKKEPPKELRQDPPILQVLGRGLVILEPLLAGEPLVSTVCNFGVVRTLTSDRLTLARDSKKIKKVAKKEKPKAVIPIYEGDYHPEPLTVEVQIQLNQCRSAEEALRMFAV

SEQ ID NO: 45655 - protein, 147 aa, Homo sapiens
  Payload ID: 9311
  Gene Symbol: LRRC43
  Gene Name: leucine rich repeat containing 43
  ENSP ID: ENSP00000438751
MECLCAHPPAGLQHLGLGHNKLLGPLESLYVTANHWPNLVSLDLGFNDLTDLQSMVTSLRTLRHLRLLVLQGNPLALVPYYRGLTIDSLAQLCVLDDITVSPNEKHLFRGLSLNGDLLAQEAQFVVTIGNIRGVLDTSVLDPEPRPE

SEQ ID NO: 45656 - protein, 670 aa, Homo sapiens
  Payload ID: 9312
  Gene Symbol: LRRC45
  Gene Name: leucine rich repeat containing 45
  Uniprot ID: Q96CN5
  ENSP ID: ENSP00000306760
MEEFRRSYSRLCRESGAEPQEAVLQQLHQLPRGRLDLATQSLTVETCRALGKLLPRETLCTELVLSDCMLSEEGATLLLRGLCANTVLRFLDLKGNNLRAAGAEALGKLLQQNKSIQSLTLEWNSLGTWDDAFATFCGGLAANGALQRLDLRNNQISHKGAEELALALKGNTTLQQLDLRWNNVGLLGGRALMNCLPSNRTLWRLDLAGNNIPGDVLRAVEQAMGHSQDRLTTFQENQARTHVLSKEVQHLREEKSKQFLDLMETIDKQREEMAKSSRASAARVGQLQEALNERHSIINALKAKLQMTEAALALSEQKAQDLGELLATAEQEQLSLSQRQAKELKLEQQEAAERESKLLRDLSAANEKNLLLQNQVDELERKFRCQQEQLFQTRQEMTSMSAELKMRAIQAEERLDMEKRRCRQSLEDSESLRIKEVEHMTRHLEESEKAMQERVQRLEAARLSLEEELSRVKAAALSERGQAEEELIKAKSQARLEEQQRLAHLEDKLRLLAQARDEAQGACLQQKQVVAEAQTRVSQLGLQVEGLRRRLEELQQELSLKDQERVAEVSRVRVELQEQNGRLQAELAAQEALREKAAALERQLKVMASDHREALLDRESENASLREKLRLREAEIARIRDEEAQRASFLQNAVLAYVQASPVRTLSPPK

SEQ ID NO: 45657 - protein, 6 aa, Homo sapiens
  Payload ID: 9312
  Gene Symbol: LRRC45
  Gene Name: leucine rich repeat containing 45
  ENSP ID: ENSP00000462276
MNCLPS

SEQ ID NO: 45658 - protein, 188 aa, Homo sapiens
  Payload ID: 9312
  Gene Symbol: LRRC45
  Gene Name: leucine rich repeat containing 45
  ENSP ID: ENSP00000462928
  MOD_RES (1)..(1): Any amino acid
XQFLDLMETIDKQREEMAKSSRASAARVGQLQEALNERHSIINALKAKLQMTEAALALSEQKAQDLGELLATAEQEQLSLSQRQAKELKLEQQEAAERESKLLRDLSAANEKNLLLQNQVDELERKFRCQQEQLFQTRQEMTSMSAELKMRAIQAEERLDMEKRRCRQSLEDSESLRIKEGGESVRRR

SEQ ID NO: 45659 - protein, 321 aa, Homo sapiens
  Payload ID: 9313
  Gene Symbol: LRRC46
  Gene Name: leucine rich repeat containing 46
  Uniprot ID: Q96FV0
  ENSP ID: ENSP00000269025
MSGGKSAQGPEEGGVCITEALITKRNLTFPEDGELSEKMFHTLDELQTVRLDREGITTIRNLEGLQNLHSLYLQGNKIQQIENLACIPSLRFLSLAGNQIRQVENLLDLPCLQFLDLSENLIETLKLDEFPQSLLILNLSGNSCTNQDGYRELVTEALPLLLDLDGQPVVERWISDEEDEASSDEEFPELSGPFCSERGFLKELEQELSRHREHRQQTALTEHLLRMEMQPTLTDLPLLPGVPMAGDSSPSATPAQGEETVPEAVSSPQASSPTKKPCSLIPRGHQSSFWGRKGARAATAPKASVAEAPSTTKTTAKRSKK

SEQ ID NO: 45660 - protein, 98 aa, Homo sapiens
  Payload ID: 9313
  Gene Symbol: LRRC46
  Gene Name: leucine rich repeat containing 46
  ENSP ID: ENSP00000462585
MSGGKSAQGPEEGGVCITEALITKRNLTFPEDGELSEKMFHTLDELQTVRLDREGITTIRNLEGLQNLHSLYLQGLQPISCFEEEETMKIPVHHSDPT

SEQ ID NO: 45661 - protein, 47 aa, Homo sapiens
  Payload ID: 9313
  Gene Symbol: LRRC46
  Gene Name: leucine rich repeat containing 46
  ENSP ID: ENSP00000463232
MSGGKSAQGPEEGGVCITEALITKRNLTFPEDGELSEKMHSAMLWNE

SEQ ID NO: 45662 - protein, 47 aa, Homo sapiens; identical to SEQ ID NO: 45661
  Payload ID: 9313
  Gene Symbol: LRRC46
  Gene Name: leucine rich repeat containing 46
  ENSP ID: ENSP00000463930

SEQ ID NO: 45663 - protein, 583 aa, Homo sapiens
  Payload ID: 9314
  Gene Symbol: LRRC47
  Gene Name: leucine rich repeat containing 47
  Uniprot ID: Q8N1G4
  ENSP ID: ENSP00000367498
MAAAAVSESWPELELAERERRRELLLTGPGLEERVRAAGGQLPPRLFTLPLLHYLEVSGCGSLRAPGPGLAQGLPQLHSLVLRRNALGPGLSPELGPLPALRVLDLSGNALEALPPGQGLGPAEPPGLPQLQSLNLSGNRLRELPADLARCAPRLQSLNLTGNCLDSFPAELFRPGALPLLSELAAADNCLRELSPDIAHLASLKTLDLSNNQLSEIPAELADCPKLKEINFRGNKLRDKRLEKMVSGCQTRSILEYLRVGGRGGGKGKGRAEGSEKEESRRKRRERKQRREGGDGEEQDVGDAGRLLLRVLHVSENPVPLTVRVSPEVRDVRPYIVGAVVRGMDLQPGNALKRFLTSQTKLHEDLCEKRTAATLATHELRAVKGPLLYCARPPQDLKIVPLGRKEAKAKELVRQLQLEAEEQRKQKKRQSVSGLHRYLHLLDGNENYPCLVDADGDVISFPPITNSEKTKVKKTTSDLFLEVTSATSLQICKDVMDALILKMAEMKKYTLENKEEGSLSDTEADAVSGQLPDPTTNPSAGKDGPSLLVVEQVRVVDLEGSLKVVYPSKADLATAPPHVTVVR

SEQ ID NO: 45664 - protein, 50 aa, Homo sapiens
  Payload ID: 9314
  Gene Symbol: LRRC47
  Gene Name: leucine rich repeat containing 47
  ENSP ID: ENSP00000462103
  MOD_RES (1)..(1): Any amino acid
XEEQRKQKKRQSVSGLHRNRLMLPEPRSFLTGYKESILFPKETLWNQSVI

SEQ ID NO: 45665 - protein, 686 aa, Homo sapiens
  Payload ID: 9315
  Gene Symbol: LRRC49
  Gene Name: leucine rich repeat containing 49
  Uniprot ID: Q8IUZ0
  ENSP ID: ENSP00000260382
MIPGKYRSVSGRAANNVNCGLHLVIQTSSLPEKNKVEFKLNKDTSSFPGRLLQHDLERNYSSRQGDHINLVSSSLSSFPILQRSSEEKILYSDRLSLERQKLTVCPIINGEDHLRLLNFQHNFITRIQNISNLQKLISLDLYDNQIEEISGLSTLRCLRVLLLGKNRIKKISNLENLKSLDVLDLHGNQITKIENINHLCELRVLNLARNFLSHVDNLNGLDSLTELNLRHNQITFVRDVDNLPCLQHLFLSFNNISSFDSVSCLADSSSLSDITFDGNPIAQESWYKHTVLQNMMQLRQLDMKRITEEERRMASVLAKKEEEKKRESHKQSLLKEKKRLTINNVARQWDLQQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 45666 - protein, 642 aa, Homo sapiens
  Payload ID: 9315
  Gene Symbol: LRRC49
  Gene Name: leucine rich repeat containing 49
  Uniprot ID: Q8IUZ0
  ENSP ID: ENSP00000414065
MRSITQGACRFIWEDKGYISGDHINLVSSSLSSFPILQRSSEEKILYSDRLSLERQKLTVCPIINGEDHLRLLNFQHNFITRIQNISNLQKLISLDLYDNQIEEISGLSTLRCLRVLLLGKNRIKKISNLENLKSLDVLDLHGNQITKIENINHLCELRVLNLARNFLSHVDNLNGLDSLTELNLRHNQITFVRDVDNLPCLQHLFLSFNNISSFDSVSCLADSSSLSDITFDGNPIAQESWYKHTVLQNMMQLRQLDMKRITEEERRMASVLAKKEEEKKRESHKQSLLKEKKRLTINNVARQWDLQQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 45667 - protein, 676 aa, Homo sapiens
  Payload ID: 9315
  Gene Symbol: LRRC49
  Gene Name: leucine rich repeat containing 49
  Uniprot ID: Q8IUZ0
  ENSP ID: ENSP00000439600
MDCQAEVNCGLHLVIQTSSLPEKNKVEFKLNKDTSSFPGRLLQHDLERNYSSRQGDHINLVSSSLSSFPILQRSSEEKILYSDRLSLERQKLTVCPIINGEDHLRLLNFQHNFITRIQNISNLQKLISLDLYDNQIEEISGLSTLRCLRVLLLGKNRIKKISNLENLKSLDVLDLHGNQITKIENINHLCELRVLNLARNFLSHVDNLNGLDSLTELNLRHNQITFVRDVDNLPCLQHLFLSFNNISSFDSVSCLADSSSLSDITFDGNPIAQESWYKHTVLQNMMQLRQLDMKRITEEERRMASVLAKKEEEKKRESHKQSLLKEKKRLTINNVARQWDLQQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 45668 - protein, 374 aa, Homo sapiens
  Payload ID: 9315
  Gene Symbol: LRRC49
  Gene Name: leucine rich repeat containing 49
  ENSP ID: ENSP00000452775
MASVLAKKEEEKKRESHKQSLLKEKKRLTINNVARQWDLQQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 45669 - protein, 96 aa, Homo sapiens
  Payload ID: 9315
  Gene Symbol: LRRC49
  Gene Name: leucine rich repeat containing 49
  ENSP ID: ENSP00000452821
MMQLRQLDMKRITEEERRMASVLAKKEEEKKRESHKQSLLKEKKRLTINNVARQWDLQQQRVANIATNEDRKDSDSPQDPCQIDGSTLSAFPEETG

SEQ ID NO: 45670 - protein, 117 aa, Homo sapiens
  Payload ID: 9315
  Gene Symbol: LRRC49
  Gene Name: leucine rich repeat containing 49
  ENSP ID: ENSP00000452894
MIPGKYRSVSGRAANNVNCGLHLVIQTSSLPEKNKVEFKLNKDTSSFPGRLLQHDLERNYSSRQELYGLEMKTATRSLSAFGDSSIKTPSKSRIQQGCHSAGPNISGDHINLVSSSL

SEQ ID NO: 45671 - protein, 30 aa, Homo sapiens
  Payload ID: 9315
  Gene Symbol: LRRC49
  Gene Name: leucine rich repeat containing 49
  ENSP ID: ENSP00000452925
MSSCPSVGEKQNQENLKSGESKKLRCLGSS

SEQ ID NO: 45672 - protein, 62 aa, Homo sapiens
  Payload ID: 9315
  Gene Symbol: LRRC49
  Gene Name: leucine rich repeat containing 49
  ENSP ID: ENSP00000453038
MIPGKYRSVSGRAANNVNCGLHLVIQTSSLPEKNKHLYLPTFYTLCLKTQHDFSSFDQVGNL

SEQ ID NO: 45673 - protein, 691 aa, Homo sapiens
  Payload ID: 9315
  Gene Symbol: LRRC49
  Gene Name: leucine rich repeat containing 49
  Uniprot ID: Q8IUZ0
  ENSP ID: ENSP00000453273
MIPGKYRSVSGRAANNVNCGLHLVIQTSSLPEKNKVRFKKVEFKLNKDTSSFPGRLLQHDLERNYSSRQGDHINLVSSSLSSFPILQRSSEEKILYSDRLSLERQKLTVCPIINGEDHLRLLNFQHNFITRIQNISNLQKLISLDLYDNQIEEISGLSTLRCLRVLLLGKNRIKKISNLENLKSLDVLDLHGNQITKIENINHLCELRVLNLARNFLSHVDNLNGLDSLTELNLRHNQITFVRDVDNLPCLQHLFLSFNNISSFDSVSCLADSSSLSDITFDGNPIAQESWYKHTVLQNMMQLRQLDMKRITEEERRMASVLAKKEEEKKRESHKQSLLKEKKRLTINNVARQWDLQQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 45674 - protein, 115 aa, Homo sapiens
  Payload ID: 9315
  Gene Symbol: LRRC49
  Gene Name: leucine rich repeat containing 49
  ENSP ID: ENSP00000453300
MMQLRQLDMKRITEEERRMASVLAKKEEEKKRESHKQSLLKEKKRLTINNVARQWDLQQQRVANIATNEDRKDSDSPQDPCQIDGSTLSAFPEETGPLDSGLNNALQGLSVIDTY

SEQ ID NO: 45675 - protein, 91 aa, Homo sapiens
  Payload ID: 9315
  Gene Symbol: LRRC49
  Gene Name: leucine rich repeat containing 49
  ENSP ID: ENSP00000453402
MMQLRQLDMKRITEKKRLTINNVARQWDLQQQRVANIATNEDRKDSDSPQDPCQIDGSTLSAFPEETGPLDSGLNNALQGLSVIDTYLVEV

SEQ ID NO: 45676 - protein, 62 aa, Homo sapiens; identical to SEQ ID NO: 45672
  Payload ID: 9315
  Gene Symbol: LRRC49
  Gene Name: leucine rich repeat containing 49
  ENSP ID: ENSP00000453456

SEQ ID NO: 45677 - protein, 74 aa, Homo sapiens
  Payload ID: 9315
  Gene Symbol: LRRC49
  Gene Name: leucine rich repeat containing 49
  ENSP ID: ENSP00000453728
MIPGKYRSVSGRAANNVNCGLHLVIQTSSLPEKNKVEFKLNKDTSSFPGRLLQHDLERNYSSRQDFTKNIKNVK

SEQ ID NO: 45678 - protein, 67 aa, Homo sapiens
  Payload ID: 9315
  Gene Symbol: LRRC49
  Gene Name: leucine rich repeat containing 49
  ENSP ID: ENSP00000453731
MIPGKYRSVSGRAANNVNCGLHLVIQTSSLPEKNKTKADRMSYHQWGRPPSFVELSTQFYNSDTKYF

SEQ ID NO: 45679 - protein, 67 aa, Homo sapiens
  Payload ID: 9315
  Gene Symbol: LRRC49
  Gene Name: leucine rich repeat containing 49
  ENSP ID: ENSP00000453807
MIPGKYRSVSGRAANNVNCGLHLVIQTSSLPEKNKVEFKLNKDTSSFPGRLLQHDLERNYSSRQDKS

SEQ ID NO: 45680 - protein, 78 aa, Homo sapiens
  Payload ID: 9315
  Gene Symbol: LRRC49
  Gene Name: leucine rich repeat containing 49
  ENSP ID: ENSP00000454026
MMQLRQLDMKRITEEERRMASVLAKKEEEKKRESHKQSLLKEKKRLTINNVARQWDLQQQRVANIATNEDRKDSDSPQ

SEQ ID NO: 45681 - protein, 392 aa, Homo sapiens
  Payload ID: 9315
  Gene Symbol: LRRC49
  Gene Name: leucine rich repeat containing 49
  ENSP ID: ENSP00000454170
MMQLRQLDMKRITEEERRMASVLAKKEEEKKRESHKQSLLKEKKRLTINNVARQWDLQQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 45682 - protein, 62 aa, Homo sapiens; identical to SEQ ID NO: 45672
  Payload ID: 9315
  Gene Symbol: LRRC49
  Gene Name: leucine rich repeat containing 49
  ENSP ID: ENSP00000454196

SEQ ID NO: 45683 - protein, 21 aa, Homo sapiens
  Payload ID: 9315
  Gene Symbol: LRRC49
  Gene Name: leucine rich repeat containing 49
  ENSP ID: ENSP00000454760
MSSCPSVGEKQNQENLKSGES

SEQ ID NO: 45684 - protein, 713 aa, Homo sapiens
  Payload ID: 9316
  Gene Symbol: LRRC4B
  Gene Name: leucine rich repeat containing 4B
  Uniprot ID: Q9NT99
  ENSP ID: ENSP00000373853
MARARGSPCPPLPPGRMSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLERVHLNHNPWHCNCDVLWLSWWLKETVPSNTTCCARCHAPAGLKGRYIGELDQSHFTCYAPVIVEPPTDLNVTEGMAAELKCRTGTSMTSVNWLTPNGTLMTHGSYRVRISVLHDGTLNFTNVTVQDTGQYTCMVTNSAGNTTASATLNVSAVDPVAAGGTGSGGGGPGGSGGVGGGSGGYTYFTTVTVETLETQPGEEALQPRGTEKEPPGPTTDGVWGGGRPGDAAGPASSSTTAPAPRSSRPTEKAFTVPITDVTENALKDLDDVMKTTKIIIGCFVAITFMAAVMLVAFYKLRKQHQLHKHHGPTRTVEIINVEDELPAASAVSVAAAAAVASGGGVGGDSHLALPALERDHLNHHHYVAAAFKAHYSSNPSGGGCGGKGPPGLNSIHEPLLFKSGSKENVQETQI

SEQ ID NO: 45685 - protein, 713 aa, Homo sapiens; identical to SEQ ID NO: 45684
  Payload ID: 9316
  Gene Symbol: LRRC4B
  Gene Name: leucine rich repeat containing 4B
  Uniprot ID: Q9NT99
  ENSP ID: ENSP00000471502

SEQ ID NO: 45686 - protein, 238 aa, Homo sapiens
  Payload ID: 9316
  Gene Symbol: LRRC4B
  Gene Name: leucine rich repeat containing 4B
  ENSP ID: ENSP00000472528
MARARGSPCPPLPPGRMSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSG

SEQ ID NO: 45687 - protein, 640 aa, Homo sapiens
  Payload ID: 9317
  Gene Symbol: LRRC4C
  Gene Name: leucine rich repeat containing 4C
  Uniprot ID: Q9HCJ2
  ENSP ID: ENSP00000278198
MLNKMTLHPQQIMIGPRFNRALFDPLLVVLLALQLLVVAGLVRAQTCPSVCSCSNQFSKVICVRKNLREVPDGISTNTRLLNLHENQIQIIKVNSFKHLRHLEILQLSRNHIRTIEIGAFNGLANLNTLELFDNRLTTIPNGAFVYLSKLKELWLRNNPIESIPSYAFNRIPSLRRLDLGELKRLSYISEGAFEGLSNLRYLNLAMCNLREIPNLTPLIKLDELDLSGNHLSAIRPGSFQGLMHLQKLWMIQSQIQVIERNAFDNLQSLVEINLAHNNLTLLPHDLFTPLHHLERIHLHHNPWNCNCDILWLSWWIKDMAPSNTACCARCNTPPNLKGRYIGELDQNYFTCYAPVIVEPPADLNVTEGMAAELKCRASTSLTSVSWITPNGTVMTHGAYKVRIAVLSDGTLNFTNVTVQDTGMYTCMVSNSVGNTTASATLNVTAATTTPFSYFSTVTVETMEPSQDEARTTDNNVGPTPVVDWETTNVTTSLTPQSTRSTEKTFTIPVTDINSGIPGIDEVMKTTKIIIGCFVAITLMAAVMLVIFYKMRKQHHRQNHHAPTRTVEIINVDDEITGDTPMESHLPMPAIEHEHLNHYNSYKSPFNHTTTVNTINSIHSSVHEPLLIRMNSKDNVQETQI

SEQ ID NO: 45688 - protein, 41 aa, Homo sapiens
  Payload ID: 9317
  Gene Symbol: LRRC4C
  Gene Name: leucine rich repeat containing 4C
  ENSP ID: ENSP00000431363
MLNKMTLHPQQIMIGPRFNRALFDPLLVVLLALQLLVVAGL

SEQ ID NO: 45689 - protein, 640 aa, Homo sapiens; identical to SEQ ID NO: 45687
  Payload ID: 9317
  Gene Symbol: LRRC4C
  Gene Name: leucine rich repeat containing 4C
  Uniprot ID: Q9HCJ2
  ENSP ID: ENSP00000434761

SEQ ID NO: 45690 - protein, 640 aa, Homo sapiens; identical to SEQ ID NO: 45687
  Payload ID: 9317
  Gene Symbol: LRRC4C
  Gene Name: leucine rich repeat containing 4C
  Uniprot ID: Q9HCJ2
  ENSP ID: ENSP00000436976

SEQ ID NO: 45691 - protein, 640 aa, Homo sapiens; identical to SEQ ID NO: 45687
  Payload ID: 9317
  Gene Symbol: LRRC4C
  Gene Name: leucine rich repeat containing 4C
  Uniprot ID: Q9HCJ2
  ENSP ID: ENSP00000437132

SEQ ID NO: 45692 - protein, 640 aa, Homo sapiens; identical to SEQ ID NO: 45687
  Payload ID: 9317
  Gene Symbol: LRRC4C
  Gene Name: leucine rich repeat containing 4C
  Uniprot ID: Q9HCJ2
  ENSP ID: ENSP00000480903

SEQ ID NO: 45693 - protein, 313 aa, Homo sapiens
  Payload ID: 9318
  Gene Symbol: LRRC52
  Gene Name: leucine rich repeat containing 52
  Uniprot ID: Q8N7C0
  ENSP ID: ENSP00000294818
MSLASGPGPGWLLFSFGMGLVSGSKCPNNCLCQAQEVICTGKQLTEYPLDIPLNTRRLFLNENRITSLPAMHLGLLSDLVYLDCQNNRIREVMDYTFIGVFKLIYLDLSSNNLTSISPFTFSVLSNLVQLNIANNPHLLSLHKFTFANTTSLRYLDLRNTGLQTLDSAALYHLTTLETLFLSGNPWKCNCSFLDFAIFLIVFHMDPSDDLNATCVEPTELTGWPITRVGNPLRYMCITHLDHKDYIFLLLIGFCIFAAGTVAAWLTGVCAVLYQNTRHKSSEEDEDEAGTRVEVSRRIFQTQTSSVQEFPQLI

SEQ ID NO: 45694 - protein, 1247 aa, Homo sapiens
  Payload ID: 9319
  Gene Symbol: LRRC53
  Gene Name: leucine rich repeat containing 53
  Uniprot ID: A6NM62
  ENSP ID: ENSP00000294635
MLRLVAACPESCVVCTKDVTLCHQLTYIVAAPMTTRVLIITDGYLSSIESTNLSLLFNLALLSLSRNGIEDVQEDALHGLTMLRTLLLEHNQISSSSLTDHTFSKLHSLQVLVLSNNALRTLRGSWFRNTSGLTRLQLDGNQITNLTDSSFGGTNLHSLRYLDLSNNFISYIGKDAFRPLPQLQEVDLSRNRLAHMPDVFTPLKQLILLSLDKNQWSCTCDLHPLARFLRNYIKSSAHTLRNAKDLNCQPSTAAVAAAQSVLRLSETNCDSKAPNFTLVLKDRSPLLPGPDVALLTVLGFAGAVGLTCLGLVVFNWKLHQGKANEHTSENLCCRTFDEPLCAHEARNYHTKGYCNCHLTQENEIKVMSTVGSRKEMPLLQENSHQATSASESATLDGSFRNLKKKDRGVGSTLFCQDGRLLHSECSEPPGNMRAFNEAGLLTTYNPRKVQKLWNLEPGEVQPQTLQHHIIRTEDISSDIFRRRYATPASALAGESLEKRLTNESWQPPIEKEDNGLHPHRQRHFITSSSSKPCEPEEHYVQKIVQKNRSKYDDPCGLLKQSKPRYFQPNNSLICKYVPCEQFEDYMKEKKPNRRQHSKPEKEQIQINSAIEKFLMSEDNIDLSGLSTKTKKAYSPKRVIFHDPDLVEINRSMMSPKISTPWKRQKNQSNQLTKLDVKKFSNTGERNKGEKWFTNSWVLKRKRTPQSDLKGKIKGQNLKLNLHPFRKVRVHPEKSLSSLPKQCKQVLLPPKKLSKTSETEAKINTVCSADFLQQSESSNYVRLTSKRLPLKHDSKQTPYYQRNTKRAPLLSANNLRVVNQSSIESSCYSAGHIPDGNTSKLPQPTPTDAEHRHSHSQFSTEQMEDATQLESKVLSYLATTWENTGSDVLPFQHSRRATDQGTTESTEHMGQNVSKTSELNQFSLSPRNQTQLLDAHKTDSYNKEYTLDQNEALQHREQNSSHAQLENKEKTLMTKPQISHQIVENCIMDKEENDVEKKLSKTETYDSSLIPQTQSKNNLSFMKTNSIPYQNRIELPKDISTSPVSSQAVWHLTNSSEKGIDSTNALPRNDGTEALEIKIVGKEEKNMLDESKTDSSMLTQISQMTLKGITKERQQTWENGTSEKYILHDASSAEETITAKDLSITSSHETQNRILCSEVDPEVNSNVHNFREVQNIQPDKDSAHKEGAMTVETHEALSFLPGLKDSFEAENEVFLVPSRINEAENSAPKPVLYPPSAEYATTSPLETE

SEQ ID NO: 45695 - protein, 341 aa, Homo sapiens
  Payload ID: 9320
  Gene Symbol: LRRC55
  Gene Name: leucine rich repeat containing 55
  Uniprot ID: Q6ZSA7
  ENSP ID: ENSP00000419542
MLRSPTFTDAGPRCSCLPVSQTLDSMDTVLMGSLQHCCCLLPKMGDTWAQLPWPGPPHPAMLLISLLLAAGLMHSDAGTSCPVLCTCRNQVVDCSSQRLFSVPPDLPMDTRNLSLAHNRITAVPPGYLTCYMELQVLDLHNNSLMELPRGLFLHAKRLAHLDLSYNNFSHVPADMFQEAHGLVHIDLSHNPWLRRVHPQAFQGLMQLRDLDLSYGGLAFLSLEALEGLPGLVTLQIGGNPWVCGCTMEPLLKWLRNRIQRCTADSQLAECRGPPEVEGAPLFSLTEESFKACHLTLTLDDYLFIAFVGFVVSIASVATNFLLGITANCCHRWSKASEEEEI

SEQ ID NO: 45696 - protein, 542 aa, Homo sapiens
  Payload ID: 9321
  Gene Symbol: LRRC56
  Gene Name: leucine rich repeat containing 56
  Uniprot ID: Q8IYG6
  ENSP ID: ENSP00000270115
MDLGWDRSRGPRRSTSSVRVRELSWQGLHNPCPQSKGPGSQRDRLGEQLVEEYLSPARLQALARVDDLRLVRTLEMCVDTREGSLGNFGVHLPNLDQLKLNGSHLGSLRDLGTSLGHLQVLWLARCGLADLDGIASLPALKELYASYNNISDLSPLCLLEQLEVLDLEGNSVEDLGQVRYLQLCPRLAMLTLEGNLVCLQPAPGPTNKVPRGYNYRAEVRKLIPQLQVLDEVPAAHTGPPAPPRLSQDWLAVKEAIKKGNGLPPLDCPRGAPIRRLDPELSLPETQSRASRPWPFSLLVRGGPLPEGLLSEDLAPEDNTSSLTHGAGQVLCGNPTKGLRERRHQCQAREPPEQLPQHRPGDPAASTSTPEPDPADSSDFLALAGLRAWREHGVRPLPYRHPESQQEGAVAPWGPRRVPEEQVHQAEPKTPSSPPSLASEPSGTSSQHLVPSPPKHPRPRDSGSSSPRWSTDLQSRGRRLRVLGSWGPGLGDGVAAVPVLRALEVASRLSPRAQGCPGPKPAPDAAARPPRAAELSHPSPVPT

SEQ ID NO: 45697 - protein, 542 aa, Homo sapiens
  Payload ID: 9321
  Gene Symbol: LRRC56
  Gene Name: leucine rich repeat containing 56
  ENSP ID: ENSP00000477831
MDLGWDRSRGPRRSTSSVRVRELSWQGLHNPCPQSKGPGSQRDRLGEQLVEEYLSPARLQALARVDDLRLVRTLEMCVDTREGSLGNFGVHLPNLDQLKLNGSHLGSLRDLGTSLGHLQVLWLARCGLADLDGIASLPALKELYASYNNISDLSPLCLLEQLEVLDLEGNSVEDLGQVRYLQLCPRLAMLTLEGNLVCLQPAPGPTNKVPRGYNYRAEVRKLIPQLQVLDEVPAAHTGPPAPPRLSQDWLAVKEAIKKGNGLPPLDCPRGAPIRRLDPELSLPETQSRASRPWPFSLLVHGGPLPEGLLSEDLAPEDNTSSLTHGAGQVLCGNPTKGLRERRHQCQAREPPEQLPQHRPGDPAASTSTPEPDPADSSDFLALAGLRAWREHGVRPLPYRHPESQQEGAVAPWGPRRVPEEQVHQAEPKTPSSPPSLASEPSGTSSQHLVPSPPKHPRPRDSGSSSPRWSTDLQSRGRRLRVLGSWGPGLGDGVAAVPVLRALEVASGLSPRAQGCPGPKPAPHAAARPPRAAELSHPSPVPT

SEQ ID NO: 45698 - protein, 239 aa, Homo sapiens
  Payload ID: 9322
  Gene Symbol: LRRC57
  Gene Name: leucine rich repeat containing 57
  Uniprot ID: Q8N9N7
  ENSP ID: ENSP00000326817
MGNSALRAHVETAQKTGVFQLKDRGLTEFPADLQKLTSNLRTIDLSNNKIESLPPLLIGKFTLLKSLSLNNNKLTVLPDEICNLKKLETLSLNNNHLRELPSTFGQLSALKTLSLSGNQLGALPPQLCSLRHLDVMDLSKNQIRSIPDSVGELQVIELNLNQNQISQISVKISCCPRLKILRLEENCLELSMLPQSILSDSQICLLAVEGNLFEIKKLRELEGYDKYMERFTATKKKFA

SEQ ID NO: 45699 - protein, 239 aa, Homo sapiens; identical to SEQ ID NO: 45698
  Payload ID: 9322
  Gene Symbol: LRRC57
  Gene Name: leucine rich repeat containing 57
  Uniprot ID: Q8N9N7
  ENSP ID: ENSP00000380319

SEQ ID NO: 45700 - protein, 239 aa, Homo sapiens; identical to SEQ ID NO: 45698
  Payload ID: 9322
  Gene Symbol: LRRC57
  Gene Name: leucine rich repeat containing 57
  Uniprot ID: Q8N9N7
  ENSP ID: ENSP00000455445

SEQ ID NO: 45701 - protein, 148 aa, Homo sapiens
  Payload ID: 9322
  Gene Symbol: LRRC57
  Gene Name: leucine rich repeat containing 57
  ENSP ID: ENSP00000456900
MGNSALRAHVETAQKTGVFQLKDRGLTEFPADLQKLTSNLRTIDLSNNKIESLPPLLIGKFTLLKSLSLNNNKLTVLPDEICNLKKLETLSLNNNHLRELPSTFGQLSALKTLSLSGNQLGALPPQLCSLRHLDVMDLSKNQIRSIPD

SEQ ID NO: 45702 - protein, 371 aa, Homo sapiens
  Payload ID: 9323
  Gene Symbol: LRRC58
  Gene Name: leucine rich repeat containing 58
  Uniprot ID: Q96CX6
  ENSP ID: ENSP00000295628
MEEAGAAVVTAGEAELNWSRLSVSTETLESELEARGEERRGAREALLRLLLPHNRLVSLPRALGSGFPHLQLLDVSGNALTALGPELLALRGLRTLLAKNNRLGGPSALPKGLAQSPLCRSLQVLNLSGNCFQEVPASLLELRALQTLSLGGNQLQSIPAEIENLQSLECLYLGGNFIKEIPPELGNLPSLNYLVLCDNKIQSIPPQLSQLHSLRSLSLHNNLLTYLPREILNLIHLEELSLRGNPLVVRFVRDLTYDPPTLLELAARTIKIRNISYTPYDLPGNLLRYLGSASNCPNPKCGGVYFDCCVRQIKFVDFCGKYRLPLMHYLCSPECSSPCSSASHSSTSQSESDSEDEASVAARRMQKVLLG

SEQ ID NO: 45703 - protein, 307 aa, Homo sapiens
  Payload ID: 9324
  Gene Symbol: LRRC59
  Gene Name: leucine rich repeat containing 59
  Uniprot ID: Q96AG4
  ENSP ID: ENSP00000225972
MTKAGSKGGNLRDKLDGNELDLSLSDLNEVPVKELAALPKATILDLSCNKLTTLPSDFCGLTHLVKLDLSKNKLQQLPADFGRLVNLQHLDLLNNKLVTLPVSFAQLKNLKWLDLKDNPLDPVLAKVAGDCLDEKQCKQCANKVLQHMKAVQADQERERQRRLEVEREAEKKREAKQRAKEAQERELRKREKAEEKERRRKEYDALKAAKREQEKKPKKEANQAPKSKSGSRPRKPPPRKHTRSWAVLKLLLLLLLFGVAGGLVACRVTELQQQPLCTSVNTIYDNAVQGLRRHEILQWVLQTDSQQ

SEQ ID NO: 45704 - protein, 62 aa, Homo sapiens
  Payload ID: 9324
  Gene Symbol: LRRC59
  Gene Name: leucine rich repeat containing 59
  ENSP ID: ENSP00000459305
MTKAGSKGGNLRDKLDGNELDLSLSDLNEVPVKELVSIVPRGPGAHLRRALAPTWATYFPLL

SEQ ID NO: 45705 - protein, 57 aa, Homo sapiens
  Payload ID: 9324
  Gene Symbol: LRRC59
  Gene Name: leucine rich repeat containing 59
  ENSP ID: ENSP00000459616
  MOD_RES (1)..(1): Any amino acid
XANQAPRCFPSALLVSAAGIRVSLFPGPSDSAWFSSGVEGCQNLFWLLPSCCSGQGR

SEQ ID NO: 45706 - protein, 411 aa, Homo sapiens
  Payload ID: 9325
  Gene Symbol: LRRC6
  Gene Name: leucine rich repeat containing 6
  ENSP ID: ENSP00000250173
MGWITEDLIRRNAEHNDCVIFSLEELSLHQQEIERLEHIDKWCRDLKILYLQNNLIGKIENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDTEEHNTKKLDNSEDDLEFWNKPCLFTPESRLETLRHMEKQRKKQEKLSEKKKKVKPPRTLITEDGKALNVNEPKIDFSLKDNEKQIILDLAVYRYMDTSLIDVDVQPTYVRVMIKGKLVLPAEVKPDSSSAKRSQTTGHLVICMPKVGEVITGGQRAFKSMKTTSDRSREQTNTSYSTGF

SEQ ID NO: 45707 - protein, 206 aa, Homo sapiens
  Payload ID: 9325
  Gene Symbol: LRRC6
  Gene Name: leucine rich repeat containing 6
  ENSP ID: ENSP00000428015
DNSEDDLEFWNKPCLFTPESRLETLRHMEKQRKKQEKLSEKKKKVKPPRTLITEDGKALNVNEPKYMDTSLIDVDVQPTYVRVMIKGKPFQLVLPAEVKPDSSSAKRSQTTGHLVICMPKVGEVITGGQRAFKSMKTTSDRSREQTNTRSKHMEKLEVDPSKHSFPDVTNIVQEKKHTPRRRPEPKIIPSEEDPTFEDNPEVPPLI

SEQ ID NO: 45708 - protein, 411 aa, Homo sapiens; identical to SEQ ID NO: 45706
  Payload ID: 9325
  Gene Symbol: LRRC6
  Gene Name: leucine rich repeat containing 6
  ENSP ID: ENSP00000428610

SEQ ID NO: 45709 - protein, 140 aa, Homo sapiens
  Payload ID: 9325
  Gene Symbol: LRRC6
  Gene Name: leucine rich repeat containing 6
  ENSP ID: ENSP00000429158
  MOD_RES (1)..(1): Any amino acid
XEKKKKVKPPRTLITEDGKALNVNEPKIDFSLKDNEKQIILDLAVYRYMDTSLIDVDVQPTYVRVMIKGKPFQLVLPAEVKPDSSSAKRSQTTGHLVICMPKGANQLMRKALLSLFMSLKQLQHSFPLFLYVFNLSKFFT

SEQ ID NO: 45710 - protein, 466 aa, Homo sapiens
  Payload ID: 9325
  Gene Symbol: LRRC6
  Gene Name: leucine rich repeat containing 6
  Uniprot ID: Q86X45
  ENSP ID: ENSP00000429791
MGWITEDLIRRNAEHNDCVIFSLEELSLHQQEIERLEHIDKWCRDLKILYLQNNLIGKIENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDTEEHNTKKLDNSEDDLEFWNKPCLFTPESRLETLRHMEKQRKKQEKLSEKKKKVKPPRTLITEDGKALNVNEPKIDFSLKDNEKQIILDLAVYRYMDTSLIDVDVQPTYVRVMIKGKPFQLVLPAEVKPDSSSAKRSQTTGHLVICMPKVGEVITGGQRAFKSMKTTSDRSREQTNTRSKHMEKLEVDPSKHSFPDVTNIVQEKKHTPRRRPEPKIIPSEEDPTFEDNPEVPPLI

SEQ ID NO: 45711 - protein, 89 aa, Homo sapiens
  Payload ID: 9325
  Gene Symbol: LRRC6
  Gene Name: leucine rich repeat containing 6
  ENSP ID: ENSP00000429811
MGWITEDLIRRNAEHNDCVIFSLEELSLHQQEIERLEHIDKWCRDLKILYLQNNLIGKIENVSKLKKLEYLNLALNNIEKIENLEDVIY

SEQ ID NO: 45712 - protein, 466 aa, Homo sapiens; identical to SEQ ID NO: 45710
  Payload ID: 9325
  Gene Symbol: LRRC6
  Gene Name: leucine rich repeat containing 6
  Uniprot ID: Q86X45
  ENSP ID: ENSP00000484634

SEQ ID NO: 45713 - protein, 466 aa, Homo sapiens
  Payload ID: 9325
  Gene Symbol: LRRC6
  Gene Name: leucine rich repeat containing 6
  ENSP ID: ENSP00000484802
MGTVTEDLIRRNAEHNDCVIFSLEELSLHQQEIERLEHIDKWCRDLKILYLQNNLIGKIENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDTEEHNTKKLDNSEDDLEFWNKPCLFTPESRLETLRHMEKQRKKQEKLSEKKKKVKPPRTLITEDGKALNVNEPKIDFSLKDNEKQIILDLAVYRYMDTSLIDVDVQPTYVRVMIKGKPFQLVLPAEVKPDSSSAKRSQTTGHLVICMPKVGEVITGGQRAFKSMKTTSDRSREQTNTRSKHMEKLEVDPSKHSFPDVTNIVQEKKHTPRRRPEPKIIPSEEDPTFEDNPEVPPLI

SEQ ID NO: 45714 - protein, 259 aa, Homo sapiens
  Payload ID: 9326
  Gene Symbol: LRRC61
  Gene Name: leucine rich repeat containing 61
  Uniprot ID: Q9BV99
  ENSP ID: ENSP00000339047
MDPPAEKPGEAGGLQITPQLLKSRTGEFSLESILLLKLRGLGLADLGCLGECLGLEWLDLSGNALTHLGPLASLRQLAVLNVSNNRLTGLEPLATCENLQSLNAAGNLLATPGQLQCLAGLPCLEYLRLRDPLARLSNPLCANPSYWAAVRELLPGLKVIDGERVIGRGSEFYQLCRDLDSSLRPSSSPGPRATEAQPWVEPGYWESWPSRSSSILEEACRQFQDTLQECWDLDRQASDSLAQAEQVLSSAGPTSSFVF

SEQ ID NO: 45715 - protein, 259 aa, Homo sapiens; identical to SEQ ID NO: 45714
  Payload ID: 9326
  Gene Symbol: LRRC61
  Gene Name: leucine rich repeat containing 61
  Uniprot ID: Q9BV99
  ENSP ID: ENSP00000352642

SEQ ID NO: 45716 - protein, 259 aa, Homo sapiens; identical to SEQ ID NO: 45714
  Payload ID: 9326
  Gene Symbol: LRRC61
  Gene Name: leucine rich repeat containing 61
  Uniprot ID: Q9BV99
  ENSP ID: ENSP00000420560

SEQ ID NO: 45717 - protein, 506 aa, Homo sapiens
  Payload ID: 9327
  Gene Symbol: LRRC63
  Gene Name: leucine rich repeat containing 63
  Uniprot ID: Q05C16
  ENSP ID: ENSP00000368082
MQKPPLLLRRPLPPKFTKLSLHEKKTHTAKTGKIESLHVAFTEDETTSIKMDRTRFPDVLRNQSLTPINIQNIFLDHCVQERVTAISSPQKSTKHVREQIPDTATGSIFFPHCNSASTRIFGKQTNKMESSRKFKTMKDVYTEKRLENILILSSKFSKPKSTPGSVIAQKLEKMHPKHQPLPESPGYTYQHISRDLSATVPSPPPMTVSMKPEGQWPEHFKSTATLTLRVTEFPGFVSLPTPVLPRKPHRQSVIETLVTENGNIESVPKQIPPRPPEGLTKTEKIESEIHVVRGEGFKTVAATRYETITAMTNLAIVNCQVYGRNALNLKGFFILNCPDLTPLAFQLIYLNLSFNDLHYFPTEILCLKNLQILKLRNNPIKEIPSEIQQLEFLRIFTIAFNLITVLPIGLFSLSYLEELDVSYNELTFIPNEIQKLRSLEKLTVDGNELSFFPHGILKLNLTKIQFENNFTHPCFWRDNYLNNPQQLTQIISLFIVQNKLHKFYDK

SEQ ID NO: 45718 - protein, 587 aa, Homo sapiens
  Payload ID: 9327
  Gene Symbol: LRRC63
  Gene Name: leucine rich repeat containing 63
  ENSP ID: ENSP00000408828
MQKPPLLLRRPLPPKFTKLSLHEKKTHTAKTGKIESLHVAFTEDETTSIKMDRTRFPDVLRNQSLTPINIQNIFLDHCVQERVTAISSPQKSTKHVREQIPDTATGSIFFPHCNSASTRIFGKQTNKMESSRKFKTMKDVYTEKRLENILILSSKFSKPKSTPGSVIAQKLEKMHPKHQPLPESPGYTYQHISRDLSATVPSPPPMTVSMKPEGQWPEHFKSTATLTLRVTEFPGFVSLPTPVLPRKPHRQSVIETLVTENGNIESVPKQIPPRPPEGLTKTEKIESEIHVVRGEGFKTVAATRYETITAMTNLAIVNCQVYGRNALNLKGFFILNCPDLTPLAFQLIYLNLSFNDLHYFPTEILCLKNLQILKLRNNPIKEIPSEIQQLEFLRIFTIAFNLITVLPIGLFSLSYLEELDVSYNELTFIPNEIQKLRSLEKLTVDGNELSFFPHGILKLNLTKIQFENNFTHPCFWRDNYLNNPQQLTQIISLFIVQNKLHKFYDKIPVEVQKLLKCTSRCEWCHGPKFGEGFRVIRSCDIFGASQLPVMFYVCSPSCYRRIKESSFVLDGSPSRRIALDVELSKEL

SEQ ID NO: 45719 - protein, 587 aa, Homo sapiens; identical to SEQ ID NO: 45718
  Payload ID: 9327
  Gene Symbol: LRRC63
  Gene Name: leucine rich repeat containing 63
  ENSP ID: ENSP00000469337

SEQ ID NO: 45720 - protein, 880 aa, Homo sapiens
  Payload ID: 9328
  Gene Symbol: LRRC66
  Gene Name: leucine rich repeat containing 66
  Uniprot ID: Q68CR7
  ENSP ID: ENSP00000341944
MKNLYFRVITIVIGLYFTGIMTNASRKSNILFNSECQWNEYILTNCSFTGKCDIPVDISQTAATVDVSFNFFRVLLQSHTKKEEWKIKHLDLSNNLISKITLSPFAYLHALEVLNLSNNAIHSLSLDLLSPKSSWVKRHRSSFRNRFPLLKVLILQRNKLSDTPKGLWKLKSLQSLDLSFNGILQIGWSDFHNCLQLENLCLKSNKIFKIPPQAFKDLKKLQVIDLSNNALITILPMMIIALEFPHLVVDLADNNWQCDDSVAVFQNFISESWRKKWNVICNRSIGSEEANGGTPQSRISRETRLPPIHLHRMKSLIRSKAERPQGGRHTGISTLGKKAKAGSGLRKKQRRLPRSVRSTRDVQAAGKKEDAPQDLALAVCLSVFITFLVAFSLGAFTRPYVDRLWQKKCQSKSPGLDNAYSNEGFYDDMEAAGHTPHPETHLRQVFPHLSLYENQTPFWVTQPHPHATVIPDRTLGRSRKDPGSSQSPGQCGDNTGAGSGNDGAVYSILQRHPHAGNRELMSAAQDHIHRNDILGEWTYETVAQEEPLSAHSVGVSSVAGTSHAVSGSSRYDSNELDPSLSGEITASLCKMLTHAEAQRTGDSKERGGTEQSLWDSQMEFSKERQVSSSIDLLSIQQPRLSGARAEEALSAHYSEVPYGDPRDTGPSVFPPRWDSGLDVTPANKEPVQKSTPSDTCCELESDCDSDEGSLFTLSSISSESARSKTEEAVPDEESLQDESSGASKDNVTAVDSLEENVTFQTIPGKCKNQEDPFEKPLISAPDSGMYKTHLENASDTDRSEGLSPWPRSPGNSPLGDEFPGMFTYDYDTALQSKAAEWHCSLRDLEFSNVDVLQQTPPCSAEVPSDPDKAAFHERDSDILK

SEQ ID NO: 45721 - protein, 191 aa, Homo sapiens
  Payload ID: 9329
  Gene Symbol: LRRC69
  Gene Name: leucine rich repeat containing 69
  Uniprot ID: Q6ZNQ3
  ENSP ID: ENSP00000343221
MTERLLIKALSGGKNTKIITLNGKKMTKMPSALGKLPGLKTLVLQNNLIPKVCPELCNLTQFQDLKLREFYCEGNPLFLQQPVISTQQENVWSLQEITSRFVMNQLAENNPFLMDDIERYPQVRSMISQGKTCAICGQYFITVWLECVRFVPPPKDWKISKNLKLVPLQVLICSYKCFTQRDPNLFGIAQV

SEQ ID NO: 45722 - protein, 347 aa, Homo sapiens
  Payload ID: 9329
  Gene Symbol: LRRC69
  Gene Name: leucine rich repeat containing 69
  Uniprot ID: Q6ZNQ3
  ENSP ID: ENSP00000400803
MTERLLIKALSGGKNTKIITLNGKKMTKMPSALGKLPGLKTLVLQNNLIPKVCPELCNLTQLTTLNLGNNLLEEVPEEMKYLTSLKNLHLSGNRICRFAPGACDGLQNLILLNLNNNHLTQLPQEVSRLKSLTYMSINYNQLASIPRELCFLENLVELQLNYNQLICIPEEIKFLKKLQKLLLARNNIGVLPEELCDLKKLRILDIAGNIIQIFPSGFQDLKLREFYCEGNPLFLQQPVISTQQENVWSLQEITSRFVMNQLAENNPFLMDDIERYPQVRSMISQGKTCAICGQYFITVWLECVRFVPPPKDWKISKNLKLVPLQVLICSYKCFTQRDPNLFGIAQV

SEQ ID NO: 45723 - protein, 50 aa, Homo sapiens
  Payload ID: 9329
  Gene Symbol: LRRC69
  Gene Name: leucine rich repeat containing 69
  ENSP ID: ENSP00000428285
MTERLLIKALSGGKNTKIITLNGKKMTKMPSALGKLPGLKTLVLQNNLIP

SEQ ID NO: 45724 - protein, 69 aa, Homo sapiens
  Payload ID: 9329
  Gene Symbol: LRRC69
  Gene Name: leucine rich repeat containing 69
  ENSP ID: ENSP00000428537
MTERLLIKALSGGKNTKIITLNGKKMTKMPSALGKLPGLKTLVLQNNLIPKVCPELCNLTQAGCGGSCL

SEQ ID NO: 45725 - protein, 1537 aa, Homo sapiens
  Payload ID: 9330
  Gene Symbol: LRRC7
  Gene Name: leucine rich repeat containing 7
  Uniprot ID: Q96NW7
  ENSP ID: ENSP00000035383
MTTKRKIIGRLVPCRCFRGEEEIISVLDYSHCSLQQVPKEVFNFERTLEELYLDANQIEELPKQLFNCQALRKLSIPDNDLSNLPTTIASLVNLKELDISKNGVQEFPENIKCCKCLTIIEASVNPISKLPDGFTQLLNLTQLYLNDAFLEFLPANFGRLVKLRILELRENHLKTLPKSMHKLAQLERLDLGNNEFGELPEVLDQIQNLRELWMDNNALQVLPGSIGKLKMLVYLDMSKNRIETVDMDISGCEALEDLLLSSNMLQQLPDSIGLLKKLTTLKVDDNQLTMLPNTIGNLSLLEEFDCSCNELESLPSTIGYLHSLRTLAVDENFLPELPREIGSCKNVTVMSLRSNKLEFLPEEIGQMQKLRVLNLSDNRLKNLPFSFTKLKELAALWLSDNQSKALIPLQTEAHPETKQRVLTNYMFPQQPRGDEDFQSDSDSFNPTLWEEQRQQRMTVAFEFEDKKEDDENAGKVKDLSCQAPWERGQRGITLQPARLSGDCCTPWARCDQQIQDMPVPQNDPQLAWGCISGLQQERSMCTPLPVAAQSTTLPSLSGRQVEINLKRYPTPYPEDLKNMVKSVQNLVGKPSHGVRVENSNPTANTEQTVKEKYEHKWPVAPKEITVEDSFVHPANEMRIGELHPSLAETPLYPPKLVLLGKDKKESTDESEVDKTHCLNNSVSSGTYSDYSPSQASSGSSNTRVKVGSLQTTAKDAVHNSLWGNRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRNAAYKHNTVNLGMLPYGGISAMHAGRSMTLNLQTKSKFDHQELPLQKTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 45726 - protein, 1495 aa, Homo sapiens
  Payload ID: 9330
  Gene Symbol: LRRC7
  Gene Name: leucine rich repeat containing 7
  ENSP ID: ENSP00000309245
MQCLEMTTKRKIIGRLVPCRCFRGEEEIISVLDYSHCSLQQVPKEVFNFERTLEELYLDANQIEELPKQLFNCQALRKLSIPDNDLSNLPTTIASLVNLKELDISKNGVQEFPENIKCCKCLTIIEASVNPISKLPDGFTQLLNLTQLYLNDAFLEFLPANFGRLVKLRILELRENHLKTLPKSMHKLAQLERLDLGNNEFGELPEVLDQIQNLRELWMDNNALQVLPGSIGKLKMLVYLDMSKNRIETVDMDISGCEALEDLLLSSNMLQQLPDSIGLLKKLTTLKVDDNQLTMLPNTIGNLSLLEEFDCSCNELESLPSTIGYLHSLRTLAVDENFLPELPREIGSCKNVTVMSLRSNKLEFLPEEIGQMQKLRVLNLSDNRLKNLPFSFTKLKELAALWLSDNQSKALIPLQTEAHPETKQRVLTNYMFPQQPRGDEDFQSDSDSFNPTLWEEQRQQRMTVAFEFEDKKEDDENAGKVKDLSCQAPWERGQRGITLQPARLSGDCCTPWARCDQQIQDMPVPQNDPQLAWGCISGLQQERSMCTPLPVAAQSTTLPSLSGRQVEINLKRYPTPYPEDLKNMVKSVQNLVGKPSHGVRVENSNPTANTEQTVKEKYEHKWPVAPKEITVEDSFVHPANEMRIGELHPSLAETPLYPPKLVLLGKDKKESTDESEVDKTHCLNNSVSSGTYSDYSPSQASSGSSNTRVKVGSLQTTAKDAVHNSLWGNRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 45727 - protein, 217 aa, Homo sapiens
  Payload ID: 9330
  Gene Symbol: LRRC7
  Gene Name: leucine rich repeat containing 7
  ENSP ID: ENSP00000359997
MMENLIRGRNPPQYQRSPCKEVRAALRKRPEEELQCLEMTTKRKIIGRLVPCRCFRGEEEIISVLDYSHCSLQQVPKEVFNFERTLEELYLDANQIEELPKQLFNCQALRKLSIPDNDLSNLPTTIASLVNLKELDISKNGVQEFPENIKCCKCLTIIEASVNPISKLPDGFTQLLNLTQLYLNDAFLEFLPANFGRLVKLRILELRENHLKTLPNI

SEQ ID NO: 45728 - protein, 821 aa, Homo sapiens
  Payload ID: 9330
  Gene Symbol: LRRC7
  Gene Name: leucine rich repeat containing 7
  ENSP ID: ENSP00000394867
MTKMLGKLRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRNAAYKHNTVNLGMLPYGGISAMHAGRSMTLNLQTKSKFDHQELPLQKTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 45729 - protein, 61 aa, Homo sapiens
  Payload ID: 9330
  Gene Symbol: LRRC7
  Gene Name: leucine rich repeat containing 7
  ENSP ID: ENSP00000466082
  MOD_RES (1)..(1): Any amino acid
XGIFVTRVQPDGPASNLLQPGDKILQANGHSFVHMEHEKAVLLLKSFQNTVDLVIQRKHLL

SEQ ID NO: 45730 - protein, 32 aa, Homo sapiens
  Payload ID: 9330
  Gene Symbol: LRRC7
  Gene Name: leucine rich repeat containing 7
  ENSP ID: ENSP00000476307
  MOD_RES (1)..(1): Any amino acid
XSFVHMEHEKAVLLLKSFQNTVDLVIQRKHLL

SEQ ID NO: 45731 - protein, 36 aa, Homo sapiens
  Payload ID: 9330
  Gene Symbol: LRRC7
  Gene Name: leucine rich repeat containing 7
  ENSP ID: ENSP00000476660
  MOD_RES (1)..(1): Any amino acid
XANGHSFVHMEHEKAVLLLKSFQNTVDLVIQRKHLL

SEQ ID NO: 45732 - protein, 25 aa, Homo sapiens
  Payload ID: 9330
  Gene Symbol: LRRC7
  Gene Name: leucine rich repeat containing 7
  ENSP ID: ENSP00000477399
  MOD_RES (1)..(1): Any amino acid
XEKAVLLLKSFQNTVDLVIQRKHLL

SEQ ID NO: 45733 - protein, 622 aa, Homo sapiens
  Payload ID: 9331
  Gene Symbol: LRRC70
  Gene Name: leucine rich repeat containing 70
  Uniprot ID: Q7Z2Q7
  ENSP ID: ENSP00000399441
MCGLQFSLPCLRLFLVVTCYLLLLLHKEILGCSSVCQLCTGRQINCRNLGLSSIPKNFPESTVFLYLTGNNISYINESELTGLHSLVALYLDNSNILYVYPKAFVQLRHLYFLFLNNNFIKRLDPGIFKGLLNLRNLYLQYNQVSFVPRGVFNDLVSVQYLNLQRNRLTVLGSGTFVGMVALRILDLSNNNILRISESGFQHLENLACLYLGSNNLTKVPSNAFEVLKSLRRLSLSHNPIEAIQPFAFKGLANLEYLLLKNSRIRNVTRDGFSGINNLKHLILSHNDLENLNSDTFSLLKNLIYLKLDRNRIISIDNDTFENMGASLKILNLSFNNLTALHPRVLKPLSSLIHLQANSNPWECNCKLLGLRDWLASSAITLNIYCQNPPSMRGRALRYINITNCVTSSINVSRAWAVVKSPHIHHKTTALMMAWHKVTTNGSPLENTETENITFWERIPTSPAGRFFQENAFGNPLETTAVLPVQIQLTTSVTLNLEKNSALPNDAASMSGKTSLICTQEVEKLNEAFDILLAFFILACVLIIFLIYKVVQFKQKLKASENSRENRLEYYSFYQSARYNVTASICNTSPNSLESPGLEQIRLHKQIVPENEAQVILFEHSAL

SEQ ID NO: 45734 - protein, 71 aa, Homo sapiens
  Payload ID: 9331
  Gene Symbol: LRRC70
  Gene Name: leucine rich repeat containing 70
  ENSP ID: ENSP00000427117
MCGLQFSLPCLRLFLVVTCYLLLLLHKEILGCSSVCQLCTGRQINCRNLGLSSIPKNFPESTVFLLASKGP

SEQ ID NO: 45735 - protein, 559 aa, Homo sapiens
  Payload ID: 9332
  Gene Symbol: LRRC71
  Gene Name: leucine rich repeat containing 71
  Uniprot ID: Q8N4P6
  ENSP ID: ENSP00000336661
MSSEQSAPGASPRAPRPGTQKSSGAVTKKGERAAKEKPATVLPPVGEEEPKSPEEYQCSGVLETDFAELCTRWGYTDFPKVVNRPRPHPPFVPSASLSEKATLDDPRLSGSCSLNSLESKYVFFRPTIQVELEQEDSKSVKEIYIRGWKVEERILGVFSKCLPPLTQLQAINLWKVGLTDKTLTTFIELLPLCSSTLRKVSLEGNPLPEQSYHKLMALDSTIAHLSLRNNNIDDRGAQLLGQALSTLHSCNRTLVSLNLGFNHIGDEGAGYIADGLRLNRSLLWLSLAHNRIQDKGALKLAEVLRAFELTHTEVVERRRLLLEKGTQERSRSPSSSRHGDSKTDREKSQMVGISNSALVDKTDKTQTMKTPKGLGKKKEKSWELAKKEEKLGSGQSPTQGTPKKEDATKAGKGKVTIPEQKPSRAKGIKIGSREKRSILLESELVVEATEVVNPLLEPVEHRDGKVFMPGNKVLLHLNLIRNRITEVGLEGFLATVQYQMQFSKAKSASKGPVGLLWLSLAKNCFAPQCPAYAIIQELMLPRDPIKAKLREDEAMAFFP

SEQ ID NO: 45736 - protein, 57 aa, Homo sapiens
  Payload ID: 9333
  Gene Symbol: LRRC72
  Gene Name: leucine rich repeat containing 72
  ENSP ID: ENSP00000371558
MSWDPNPVPRTLRCWRLRRASETALQSSRRAVEDQLKICGHRRDADVFELFLSKKTG

SEQ ID NO: 45737 - protein, 287 aa, Homo sapiens
  Payload ID: 9333
  Gene Symbol: LRRC72
  Gene Name: leucine rich repeat containing 72
  Uniprot ID: A6NJI9
  ENSP ID: ENSP00000384971
MSWDPNPVPRTLRCWRLRRASETALQSSRRAVEDQLKICGHRRDADVFELFLSKKELTEVIDLSRFKKLKYLWLHHNKLHGITFLTRNYCLTELYLNNNAIFEIEGLHYLPSLHILLLHHNELTNIDATVKELKGMLNLKILSLYQNPLCQYNLYRLYIIYHLPGVELLDRNQVTEKERRSMITIFNHKKAHIVQSIAFGGKVDASWDPKSPFKQKPAQRVPSDFAFANNVDKTVLDDPEDAVFVRSMKRSVMTLTSMNWDTVPTREERYLEEEGTETAQMLTVTLR

SEQ ID NO: 45738 - protein, 316 aa, Homo sapiens
  Payload ID: 9334
  Gene Symbol: LRRC73
  Gene Name: leucine rich repeat containing 73
  Uniprot ID: Q5JTD7
  ENSP ID: ENSP00000361518
MLPSSIQISGEPLSGAEVRDICRGLRDNAVRLLSLRGCRLCDRDFGRICRALAGATSLAQLNLNLGVVSSPSRIKQLAEALRTNRSIQSLFLHGSPLTDAGLALLNPALALHPALVALDLGDCMLGDEAINLICGLLPPDGAKSGLKELTLSANPGITPKGWSRLAIAVAHSSQVRVLNLDYNPLGDHVAGMLAVAVASSRTLEVLDLEGTGLTNQSAQTLLDMVENYPTALRSLVLAENSISPELQQQICDLLSEGEEEEEVAGGAGDTQEWERGREPAAHQRGSSSWMCPSDPSSQMVLMTSGLGDSLLAETEM

SEQ ID NO: 45739 - protein, 200 aa, Homo sapiens
  Payload ID: 9335
  Gene Symbol: LRRC74A
  Gene Name: leucine rich repeat containing 74A
  ENSP ID: ENSP00000216450
MHIQFPSKPTLPRACWEGRITAGSPGMPPDEIEIEPVRQSSDKMLYCEAESPPTVEKVKPARENSETDLEIEDDEKFFTTGQKELYLEACKLMGVVPVSYFIRNMEESYVNLNHHGLGPRGTKAIAIALVSNMAVTKLELEDNCIMEEGVLSLVEMLQENYYLQEMEMTSRKTPQHCSAKPCRPITKLKSWISVTTNSLM

SEQ ID NO: 45740 - protein, 488 aa, Homo sapiens
  Payload ID: 9335
  Gene Symbol: LRRC74A
  Gene Name: leucine rich repeat containing 74A
  Uniprot ID: Q0VAA2
  ENSP ID: ENSP00000377369
MHIQFPSKPTLPRACWEGRITAGSPGMPPDEIEIEPVRQSSDKMLYCEAESPPTVEKVKPARENSETDLEIEDDEKFFTTGQKELYLEACKLMGVVPVSYFIRNMEESYVNLNHHGLGPRGTKAIAIALVSNMAVTKLELEDNCIMEEGVLSLVEMLQENYYLQEMNISNNHLGLEGARIISDFFERNSSSIWSLELSGNDFKEDSAALLCQALSTNYQIKKLDLSHNQFSDVGGEHLGQMLAINVGLTSLDLSWNNFHTRGAVALCNGLRGNVTLTKLDLSMNGFGNEVALALGEVLRLNRCLVYLDIGGNDIGNEGASKISKGLESNESLRVLKLFLNPINMDGAILLILAIKRNPKSRMEELDISNVLVSEQFMKTLDGVYAVHPQLDVVFKAVQGLSPKKTIFLLTNPMKLIQSYADQHKITIVDFFKSLNPTGTMKMSVDEFQKVMIEQNKVPLNQYQVREVIKKLDEKTGMVNFSFLNTMKP

SEQ ID NO: 45741 - protein, 155 aa, Homo sapiens
  Payload ID: 9335
  Gene Symbol: LRRC74A
  Gene Name: leucine rich repeat containing 74A
  ENSP ID: ENSP00000451057
MHIQFPSKPTLPRACWEGRITAGSPGMPPDEIEIEPVRQSSDKMLYCEAESPPTVEKVKPARENSETDLEIEGEHGHLGAVRAASPQKLEKSGFQELSSHSFPESALRMACGGNVAERPARFCLESSSGLAGESSCSFPRLSPASGAVPSRRLVK

SEQ ID NO: 45742 - protein, 40 aa, Homo sapiens
  Payload ID: 9335
  Gene Symbol: LRRC74A
  Gene Name: leucine rich repeat containing 74A
  ENSP ID: ENSP00000452348
MHIQFPSKPTLPRACWEGRITAGSPGMPPGEGSSQSLRQR

SEQ ID NO: 45743 - protein, 40 aa, Homo sapiens; identical to SEQ ID NO: 45742
  Payload ID: 9335
  Gene Symbol: LRRC74A
  Gene Name: leucine rich repeat containing 74A
  ENSP ID: ENSP00000452427

SEQ ID NO: 45744 - protein, 392 aa, Homo sapiens
  Payload ID: 9336
  Gene Symbol: LRRC74B
  Gene Name: leucine rich repeat containing 74B
  Uniprot ID: Q6ZQY2
  ENSP ID: ENSP00000394078
MRGSCERSGEDEEQKEEAMVACGRLSGVPEAEQGPEANWDSDLETEGTDGLGELVRDTLYLRSCRAHSVVPISCFLRQGSAQELNLRHRGLGPQGARALASSLSSNPYVKRLDLRDNGLCGAGAEALAGALSKSSSIHDVDLSENQLGVAGAQALCAALTVNQAMRKMQLSGNGLEEQAAQHLAELLLAHTDLKSLDLSYNQLNDQAGETLGPALAENTGLTELNVSWNHLRGPGAVAFARGLEANIFLKVLDISYNGFGDPGASAVGEALKANNVLEELNMSNNRISAMGALSLGLGLRVNQTLRILVVSRNPMRSEGCFGLLKSVQDNPASALELLDFSDIQVNAEFDGLASSVRGILPELCIKTGACRVEYKKELLPVFRSALPASVPK

SEQ ID NO: 45745 - protein, 212 aa, Homo sapiens
  Payload ID: 9337
  Gene Symbol: LRRC75A
  Gene Name: leucine rich repeat containing 75A
  Uniprot ID: Q8NAA5
  ENSP ID: ENSP00000386504
MGTRQTKGSLAERASPGAAPGPRRERPDFWASLLLRAGDKAGRAGAGMPPYHRRVGMVQELLRMVRQGRREEAGTLLQHLRQDLGMESTSLDDVLYRYASFRNLVDPITHDLIISLARYIHCPKPPQGCPGRKPPRQHSGPVGNPTDLPRPGAGDQLPTALWGAGRQRGAGLHRPHGRHGPAAAASTQHPAPPHHTGTQWQPVDPGRAARPH

SEQ ID NO: 45746 - protein, 344 aa, Homo sapiens
  Payload ID: 9337
  Gene Symbol: LRRC75A
  Gene Name: leucine rich repeat containing 75A
  Uniprot ID: Q8NAA5
  ENSP ID: ENSP00000419502
MGTRQTKGSLAERASPGAAPGPRRERPDFWASLLLRAGDKAGRAGAGMPPYHRRVGMVQELLRMVRQGRREEAGTLLQHLRQDLGMESTSLDDVLYRYASFRNLVDPITHDLIISLARYIHCPKPEGDALGAMEKLCRQLTYHLSPHSQWRRHRGLVKRKPQACLKAVLAGSPPDNTVDLSGIPLTSRDLERVTSYLQRCGEQVDSVELGFTGLTDDMVLQLLPALSTLPRLTTLALNGNRLTRAVLRDLTDILKDPSKFPNVTWIDLGNNVDIFSLPQPFLLSLRKRSPKQGHLPTILELGEGPGSGEEVREGTVGQEDPGGGPVAPAEDHHEGKETVAAAQT

SEQ ID NO: 45747 - protein, 315 aa, Homo sapiens
  Payload ID: 9338
  Gene Symbol: LRRC75B
  Gene Name: leucine rich repeat containing 75B
  Uniprot ID: Q2VPJ9
  ENSP ID: ENSP00000320520
MGARLGRRAGPEAGSEAGAAAGCGPAPYERRVRWLREIQSTLRERRPERARQLLRLLRQDLGLERTLLPDILYRDVAFLNPVDPISHDLLVNLARDLQCPKKDYELWKSSDKICRQLIYHLTPHSKQQQGSSLRQRKTQSCLKSSLQKTLLAGETVDLSGIPLSTQDVQHITRYLSSHGAVLAVLDLSFTGLSDELLHLLLPSLWALPRLTQLLLNGNRLTRATARKLTDAIKDTTKFPALAWVDLGNNVDVASLPQPLLVGLRRRLSQRTSLPTIYEGLDLEPEGSAAGATTPASTWDSTAAGLGPEPQACCAR

SEQ ID NO: 45748 - protein, 74 aa, Homo sapiens
  Payload ID: 9338
  Gene Symbol: LRRC75B
  Gene Name: leucine rich repeat containing 75B
  ENSP ID: ENSP00000384130
MGARLGRRAGPEAGSEAGAAAGCGPAPYERRVRWLREIQSTLRERRPERARQLLRLLRQDPGDSGPWREDPGLV

SEQ ID NO: 45749 - protein, 108 aa, Homo sapiens
  Payload ID: 9338
  Gene Symbol: LRRC75B
  Gene Name: leucine rich repeat containing 75B
  ENSP ID: ENSP00000400102
MGARLGRRAGPEAGSEAGAAAGCGPAPYERRVRWLREIQSTLRERRPERARQLLRLLRQDLGLERTLLPDILYRDVAFLNPVDPISHDLLVNLARDLQCPKKLPRTPC

SEQ ID NO: 45750 - protein, 810 aa, Homo sapiens
  Payload ID: 9339
  Gene Symbol: LRRC8A
  Gene Name: leucine rich repeat containing 8 family, member A
  Uniprot ID: Q8IWT6
  ENSP ID: ENSP00000259324
MIPVTELRYFADTQPAYRILKPWWDVFTDYISIVMLMIAVFGGTLQVTQDKMICLPCKWVTKDSCNDSFRGWAAPGPEPTYPNSTILPTPDTGPTGIKYDLDRHQYNYVDAVCYENRLHWFAKYFPYLVLLHTLIFLACSNFWFKFPRTSSKLEHFVSILLKCFDSPWTTRALSETVVEESDPKPAFSKMNGSMDKKSSTVSEDVEATVPMLQRTKSRIEQGIVDRSETGVLDKKEGEQAKALFEKVKKFRTHVEEGDIVYRLYMRQTIIKVIKFILIICYTVYYVHNIKFDVDCTVDIESLTGYRTYRCAHPLATLFKILASFYISLVIFYGLICMYTLWWMLRRSLKKYSFESIREESSYSDIPDVKNDFAFMLHLIDQYDPLYSKRFAVFLSEVSENKLRQLNLNNEWTLDKLRQRLTKNAQDKLELHLFMLSGIPDTVFDLVELEVLKLELIPDVTIPPSIAQLTGLKELWLYHTAAKIEAPALAFLRENLRALHIKFTDIKEIPLWIYSLKTLEELHLTGNLSAENNRYIVIDGLRELKRLKVLRLKSNLSKLPQVVTDVGVHLQKLSINNEGTKLIVLNSLKKMANLTELELIRCDLERIPHSIFSLHNLQEIDLKDNNLKTIEEIISFQHLHRLTCLKLWYNHIAYIPIQIGNLTNLERLYLNRNKIEKIPTQLFYCRKLRYLDLSHNNLTFLPADIGLLQNLQNLAITANRIETLPPELFQCRKLRALHLGNNVLQSLPSRVGELTNLTQIELRGNRLECLPVELGECPLLKRSGLVVEEDLFNTLPPEVKERLWRADKEQA

SEQ ID NO: 45751 - protein, 810 aa, Homo sapiens; identical to SEQ ID NO: 45750
  Payload ID: 9339
  Gene Symbol: LRRC8A
  Gene Name: leucine rich repeat containing 8 family, member A
  Uniprot ID: Q8IWT6
  ENSP ID: ENSP00000361680

SEQ ID NO: 45752 - protein, 810 aa, Homo sapiens; identical to SEQ ID NO: 45750
  Payload ID: 9339
  Gene Symbol: LRRC8A
  Gene Name: leucine rich repeat containing 8 family, member A
  Uniprot ID: Q8IWT6
  ENSP ID: ENSP00000361682

SEQ ID NO: 45753 - protein, 803 aa, Homo sapiens
  Payload ID: 9340
  Gene Symbol: LRRC8B
  Gene Name: leucine rich repeat containing 8 family, member B
  Uniprot ID: Q6P9F7
  ENSP ID: ENSP00000332674
MITLTELKCLADAQSSYHILKPWWDVFWYYITLIMLLVAVLAGALQLTQSRVLCCLPCKVEFDNHCAVPWDILKASMNTSSNPGTPLPLPLRIQNDLHRQQYSYIDAVCYEKQLHWFAKFFPYLVLLHTLIFAACSNFWLHYPSTSSRLEHFVAILHKCFDSPWTTRALSETVAEQSVRPLKLSKSKILLSSSGCSADIDSGKQSLPYPQPGLESAGIESPTSSVLDKKEGEQAKAIFEKVKRFRMHVEQKDIIYRVYLKQIIVKVILFVLIITYVPYFLTHITLEIDCSVDVQAFTGYKRYQCVYSLAEIFKVLASFYVILVILYGLTSSYSLWWMLRSSLKQYSFEALREKSNYSDIPDVKNDFAFILHLADQYDPLYSKRFSIFLSEVSENKLKQINLNNEWTVEKLKSKLVKNAQDKIELHLFMLNGLPDNVFELTEMEVLSLELIPEVKLPSAVSQLVNLKELRVYHSSLVVDHPALAFLEENLKILRLKFTEMGKIPRWVFHLKNLKELYLSGCVLPEQLSTMQLEGFQDLKNLRTLYLKSSLSRIPQVVTDLLPSLQKLSLDNEGSKLVVLNNLKKMVNLKSLELISCDLERIPHSIFSLNNLHELDLRENNLKTVEEIISFQHLQNLSCLKLWHNNIAYIPAQIGALSNLEQLSLDHNNIENLPLQLFLCTKLHYLDLSYNHLTFIPEEIQYLSNLQYFAVTNNNIEMLPDGLFQCKKLQCLLLGKNSLMNLSPHVGELSNLTHLELIGNYLETLPPELEGCQSLKRNCLIVEENLLNTLPLPVTERLQTCLDKC

SEQ ID NO: 45754 - protein, 230 aa, Homo sapiens [sequence omitted]

SEQ ID NO: 45755 - protein, 103 aa, Homo sapiens
  Payload ID: 9340
  Gene Symbol: LRRC8B
  Gene Name: leucine rich repeat containing 8 family, member B
  ENSP ID: ENSP00000395832
MITLTELKCLADAQSSYHILKPWWDVFWYYITLIMLLVAVLAGALQLTQSRVLCCLPCKVEFDNHCAVPWDILKASMNTSSNPGTPLPLPLRIQNDLHRQQYS

SEQ ID NO: 45756 - protein, 803 aa, Homo sapiens; identical to SEQ ID NO: 45753
  Payload ID: 9340
  Gene Symbol: LRRC8B
  Gene Name: leucine rich repeat containing 8 family, member B
  Uniprot ID: Q6P9F7
  ENSP ID: ENSP00000400704

SEQ ID NO: 45757 - protein, 803 aa, Homo sapiens
  Payload ID: 9341
  Gene Symbol: LRRC8C
  Gene Name: leucine rich repeat containing 8 family, member C
  Uniprot ID: Q8TDW0
  ENSP ID: ENSP00000359483
MIPVTEFRQFSEQQPAFRVLKPWWDVFTDYLSVAMLMIGVFGCTLQVMQDKIICLPKRVQPAQNHSSLSNVSQAVASTTPLPPPKPSPANPITVEMKGLKTDLDLQQYSFINQMCYERALHWYAKYFPYLVLIHTLVFMLCSNFWFKFPGSSSKIEHFISILGKCFDSPWTTRALSEVSGEDSEEKDNRKNNMNRSNTIQSGPEDSLVNSQSLKSIPEKFVVDKSTAGALDKKEGEQAKALFEKVKKFRLHVEEGDILYAMYVRQTVLKVIKFLIIIAYNSALVSKVQFTVDCNVDIQDMTGYKNFSCNHTMAHLFSKLSFCYLCFVSIYGLTCLYTLYWLFYRSLREYSFEYVRQETGIDDIPDVKNDFAFMLHMIDQYDPLYSKRFAVFLSEVSENKLKQLNLNNEWTPDKLRQKLQTNAHNRLELPLIMLSGLPDTVFEITELQSLKLEIIKNVMIPATIAQLDNLQELSLHQCSVKIHSAALSFLKENLKVLSVKFDDMRELPPWMYGLRNLEELYLVGSLSHDISRNVTLESLRDLKSLKILSIKSNVSKIPQAVVDVSSHLQKMCIHNDGTKLVMLNNLKKMTNLTELELVHCDLERIPHAVFSLLSLQELDLKENNLKSIEEIVSFQHLRKLTVLKLWHNSITYIPEHIKKLTSLERLSFSHNKIEVLPSHLFLCNKIRYLDLSYNDIRFIPPEIGVLQSLQYFSITCNKVESLPDELYFCKKLKTLKIGKNSLSVLSPKIGNLLFLSYLDVKGNHFEILPPELGDCRALKRAGLVVEDALFETLPSDVREQMKTE

SEQ ID NO: 45758 - protein, 58 aa, Homo sapiens
  Payload ID: 9341
  Gene Symbol: LRRC8C
  Gene Name: leucine rich repeat containing 8 family, member C
  ENSP ID: ENSP00000436638
MIPVTEFRQFSEQQPAFRVLKPWWDVFTDYLSVAMLMIGVFGCTLQAVSLKLSGFILF

SEQ ID NO: 45759 - protein, 858 aa, Homo sapiens
  Payload ID: 9342
  Gene Symbol: LRRC8D
  Gene Name: leucine rich repeat containing 8 family, member D
  Uniprot ID: Q7L1W4
  ENSP ID: ENSP00000338887
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMTILDKKDGEQAKALFEKVRKFRAHVEDSDLIYKLYVVQTVIKTAKFIFILCYTANFVNAISFEHVCKPKVEHLIGYEVFECTHNMAYMLKKLLISYISIICVYGFICLYTLFWLFRIPLKEYSFEKVREESSFSDIPDVKNDFAFLLHMVDQYDQLYSKRFGVFLSEVSENKLREISLNHEWTFEKLRQHISRNAQDKQELHLFMLSGVPDAVFDLTDLDVLKLELIPEAKIPAKISQMTNLQELHLCHCPAKVEQTAFSFLRDHLRCLHVKFTDVAEIPAWVYLLKNLRELYLIGNLNSENNKMIGLESLRELRHLKILHVKSNLTKVPSNITDVAPHLTKLVIHNDGTKLLVLNSLKKMMNVAELELQNCELERIPHAIFSLSNLQELDLKSNNIRTIEEIISFQHLKRLTCLKLWHNKIVTIPPSITHVKNLESLYFSNNKLESLPVAVFSLQKLRCLDVSYNNISMIPIEIGLLQNLQHLHITGNKVDILPKQLFKCIKLRTLNLGQNCITSLPEKVGQLSQLTQLELKGNCLDRLPAQLGQCRMLKKSGLVVEDHLFDTLPLEVKEALNQDINIPFANGI

SEQ ID NO: 45760 - protein, 858 aa, Homo sapiens; identical to SEQ ID NO: 45759
  Payload ID: 9342
  Gene Symbol: LRRC8D
  Gene Name: leucine rich repeat containing 8 family, member D
  Uniprot ID: Q7L1W4
  ENSP ID: ENSP00000378093

SEQ ID NO: 45761 - protein, 274 aa, Homo sapiens
  Payload ID: 9342
  Gene Symbol: LRRC8D
  Gene Name: leucine rich repeat containing 8 family, member D
  ENSP ID: ENSP00000405784
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMT

SEQ ID NO: 45762 - protein, 116 aa, Homo sapiens
  Payload ID: 9342
  Gene Symbol: LRRC8D
  Gene Name: leucine rich repeat containing 8 family, member D
  ENSP ID: ENSP00000415117
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYP

SEQ ID NO: 45763 - protein, 186 aa, Homo sapiens
  Payload ID: 9342
  Gene Symbol: LRRC8D
  Gene Name: leucine rich repeat containing 8 family, member D
  ENSP ID: ENSP00000433422
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKY

SEQ ID NO: 45764 - protein, 121 aa, Homo sapiens
  Payload ID: 9342
  Gene Symbol: LRRC8D
  Gene Name: leucine rich repeat containing 8 family, member D
  ENSP ID: ENSP00000435504
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFA

SEQ ID NO: 45765 - protein, 30 aa, Homo sapiens
  Payload ID: 9342
  Gene Symbol: LRRC8D
  Gene Name: leucine rich repeat containing 8 family, member D
  ENSP ID: ENSP00000435609
MFTLAEVASLNDIQPTYRILKPWWDVFMDY

SEQ ID NO: 45766 - protein, 796 aa, Homo sapiens
  Payload ID: 9343
  Gene Symbol: LRRC8E
  Gene Name: leucine rich repeat containing 8 family, member E
  Uniprot ID: Q6NSJ5
  ENSP ID: ENSP00000306524
MIPVAEFKQFTEQQPAFKVLKPWWDVLAEYLTVAMLMIGVFGCTLQVTQDKIICLPNHELQENLSEAPCQQLLPRGIPEQIGALQEVKGLKNNLDLQQYSFINQLCYETALHWYAKYFPYLVVIHTLIFMVCTSFWFKFPGTSSKIEHFISILGKCFDSPWTTRALSEVSGENQKGPAATERAAATIVAMAGTGPGKAGEGEKEKVLAEPEKVVTEPPVVTLLDKKEGEQAKALFEKVKKFRMHVEEGDILYTMYIRQTVLKVCKFLAILVYNLVYVEKISFLVACRVETSEVTGYASFCCNHTKAHLFSKLAFCYISFVCIYGLTCIYTLYWLFHRPLKEYSFRSVREETGMGDIPDVKNDFAFMLHLIDQYDSLYSKRFAVFLSEVSESRLKQLNLNHEWTPEKLRQKLQRNAAGRLELALCMLPGLPDTVFELSEVESLRLEAICDITFPPGLSQLVHLQELSLLHSPARLPFSLQVFLRDHLKVMRVKCEELREVPLWVFGLRGLEELHLEGLFPQELARAATLESLRELKQLKVLSLRSNAGKVPASVTDVAGHLQRLSLHNDGARLVALNSLKKLAALRELELVACGLERIPHAVFSLGALQELDLKDNHLRSIEEILSFQHCRKLVTLRLWHNQIAYVPEHVRKLRSLEQLYLSYNKLETLPSQLGLCSGLRLLDVSHNGLHSLPPEVGLLQNLQHLALSYNALEALPEELFFCRKLRTLLLGDNQLSQLSPHVGALRALSRLELKGNRLEALPEELGNCGGLKKAGLLVEDTLYQGLPAEVRDKMEEE

SEQ ID NO: 45767 - protein, 187 aa, Homo sapiens
  Payload ID: 9343
  Gene Symbol: LRRC8E
  Gene Name: leucine rich repeat containing 8 family, member E
  ENSP ID: ENSP00000470302
MIPVAEFKQFTEQQPAFKVLKPWWDVLAEYLTVAMLMIGVFGCTLQVTQDKIICLPNHELQENLSEAPCQQLLPRGIPEQIGALQEVKGLKNNLDLQQYSFINQLCYETALHWYAKYFPYLVVIHTLIFMVCTSFWFKFPGTSSKIEHFISILGKCFDSPWTTRALSEVSGENQKGPAATERAAATI

SEQ ID NO: 45768 - protein, 137 aa, Homo sapiens
  Payload ID: 9343
  Gene Symbol: LRRC8E
  Gene Name: leucine rich repeat containing 8 family, member E
  ENSP ID: ENSP00000472491
MIPVAEFKQFTEQQPAFKVLKPWWDVLAEYLTVAMLMIGVFGCTLQVTQDKIICLPNHELQENLSEAPCQQLLPRGIPEQIGALQEVKGLKNNLDLQQYSFINQLCYETALHWYAKYFPYLVVIHTLIFMVCTSFWF

SEQ ID NO: 45769 - protein, 95 aa, Homo sapiens
  Payload ID: 9343
  Gene Symbol: LRRC8E
  Gene Name: leucine rich repeat containing 8 family, member E
  ENSP ID: ENSP00000472642
MIPVAEFKQFTEQQPAFKVLKPWWDVLAEYLTVAMLMIGVFGCTLQVTQDKIICLPNHELQENLSEAPCQQLLPRGIPEQIGALQEVKGLKNNLD

SEQ ID NO: 45770 - protein, 73 aa, Homo sapiens
  Payload ID: 9343
  Gene Symbol: LRRC8E
  Gene Name: leucine rich repeat containing 8 family, member E
  ENSP ID: ENSP00000473127
MVCTSFWFKFPGTSSKIEHFISILGKCFDSPWTTRALSEVSGENQKGPAATERAAATIVAMAGTGPGKAGEGE

SEQ ID NO: 45771 - protein, 796 aa, Homo sapiens; identical to SEQ ID NO: 45766
  Payload ID: 9343
  Gene Symbol: LRRC8E
  Gene Name: leucine rich repeat containing 8 family, member E
  Uniprot ID: Q6NSJ5
  ENSP ID: ENSP00000479953

SEQ ID NO: 45772 - protein, 1453 aa, Homo sapiens
  Payload ID: 9344
  Gene Symbol: LRRC9
  Gene Name: leucine rich repeat containing 9
  Uniprot ID: Q6ZRR7
  ENSP ID: ENSP00000454748
MIESENLNQEEIIKELCLCNGLSYEMVGQEGSDTSKLEMFFLGYPRIVGLSLFPNLTSLTIVAQDIKEISGLEPCLQLKELWIAECCIEKIEGLQECRNLEKLYLYFNKISKIENLEKLIKLKVLWLNHNTIKNIEGLQTLKNLKDLNLAGNLINSIGRCLDSNEQLERLNLSGNQICSFKELTNLTRLPCLKDLCLNDPQYTTNPVCLLCNYSTHVLYHLPCLQRFDTLDVSAKQIKELADTTAMKKIMYYNMRIKTLQRHLKEDLEKLNDQKCKLQKLPEERVKLFSFVKKTLERELAELKGSGKGHSDGSNNSKVTDPETLKSCETVTEEPSLQQKILAKLNALNERVTFWNKKLDEIEAIYHIEVKQKKKSHGLLIPLLLIELETVGNFHFEEGTRSDDWFNFCYELILSRFCAWDFRTYGITGVKVKRIIKVNNRILRLKFEEKFQKFLENEDMHDSESYRRMLECLFYVFDPEVSVKKKHLLQILEKGFKDSETSKLPLKKEAIIVSNSLSISECPRIEFLQQKHKDEKKISLKHELFRHGILLITKVFLGQSVQAHEKESISQSNYPMVNSVFIPRKYLLNSVMGQRNCDCSVRQCKWFVFDHDLVLPEYVVEFEYITMVKAPSLFSVFNNVILEESKKNPEVSVFSKDLKFDDEVIKMEPRIKARPKLISLDDKTILSLAKTSVYSHIVSLNLHGNSLSKLRDLSKLTGLRKLNISFNEFTCLDDVYHLYNLEYLDASHNHVITLEGFRGLMKLKHLDLSWNQLKKSGNEINMLCKHTTSLLTLDIQHNPWQKPATLRLSVIGRLKTLTHLNGVFISEEEATAAMKFIAGTRITQLSLLRHSSTKEERPRILSIWPSAKILTQVSKLGPHLHLSGNCYLKITALNLDGQHLFEITNLEKLENLKWASFSNNNLTKMEGLESCINLEELTLDGNCISKIEGISKMTKLTRLSINNNLLTGWEEHTFDNMLHLHSLSLENNRITSLSGLQKSFTLVELYISNNYIAVNQEMHNLKGLCNLVILDMCGNIIIWNQENYRLFVIFHLPELKALDGIPIEPSETDSAKDLFGGRLTSDMIAERQGHSNFKQMQELNWTSSSIRTVDLIPVDQFRNVCNVNLQNNHLTSFSGLIYLPNVKVLCLNYNHIESIMPRLKPQTHLTSRQLLYQKVPSSGYGQQGISKTNRDIMSSENLPPIMHSLEVLHLGYNGICNLIQLQLNRLRNLKFLFLQGNEISQVEGLDNLVVLQELVVDHNRIRSFNDSAFAKPSSLLALHLEENRLRELGKLQSLVKLEKLFLGYNKIQDITELEKLDVISTLRELTVYGNPICRKMLHRHMLIFRLPNLQMLDGSPVNSDDRAKAEFHLAELQAKKNSLIPVTHSPMDGRSFGQVKTPPIEITNVLLPSGFSHYLGSDVTLTPEVEEFLGATFQDQIECNCLKRNEHTPRNSPV

SEQ ID NO: 45773 - protein, 1111 aa, Homo sapiens
  Payload ID: 9344
  Gene Symbol: LRRC9
  Gene Name: leucine rich repeat containing 9
  Uniprot ID: Q6ZRR7
  ENSP ID: ENSP00000454848
MIESENLNQEEIIKELCLCNGLSYEMVGQEGSDTSKLEMFFLGYPRIVGLSLFPNLTSLTIVAQDIKEISGLEPCLQLKELWIAECCIEKIEGLQECRNLEKLYLYFNKISKIENLEKLIKLKVLWLNHNTIKNIEGLQTLKNLKDLNLAGNLINSIGRCLDSNEQLERLNLSGNQICSFKELTNLTRLPCLKDLCLNDPQYTTNPVCLLCNYSTHVLYHLPCLQRFDTLDVSAKQIKELADTTAMKKIMYYNMRIKTLQRHLKEDLEKLNDQKCKLQKLPEERVKLFSFVKKTLERELAELKGSGKGHSDGSNNSKVTDPETLKSCETVTEEPSLQQKILAKLNALNERVTFWNKKLDEIEAIYHIEVKQKKKSHGLLIPLLLIELETVGNFHFEEGTRSDDWFNFCYELILSRFCAWDFRTYGITGVKVKRIIKVNNRILRLKFEEKFQKFLENEDMHDSESYRRMLECLFYVFDPEVSVKKKHLLQILEKGFKDSETSKLPLKKEAIIVSNSLSISECPRIEFLQQKHKDEKKISLKHELFRHGILLITKVFLGQSVQAHEKESISQSNYPMVNSVFIPRKYLLNSVMGQRNCDCSVRQCKWFVFDHDLVLPEYVVEFEYITMVKAPSLFSVFNNVILEESKKNPEVSVFSKDLKFDDEVIKMEPRIKARPKLISLDDKTILSLAKTSVYSHIVSLNLHGNSLSKLRDLSKLTGLRKLNISFNEFTCLDDVYHLYNLEYLDASHNHVITLEGFRGLMKLKHLDLSWNQLKKSGNEINMLCKHTTSLLTLDIQHNPWQKPATLRLSVIGRLKTLTHLNGVFISEEEATAAMKFIAGTRITQLSLLRHSSTKEERPRILSIWPSAKILTQVSKLGPHLHLSGNCYLKITALNLDGQHLFEITNLEKLENLKWASFSNNNLTKMEGLESCINLEELTLDGNCISKIEGISKMTKLTRLSINNNLLTGWEEHTFDNMLHLHSLSLENNRITSLSGLQKSFTLVELYISNNYIAVNQEMHNLKGLCNLVILDMCGNIIIWNQENYRLFVIFHLPELKALDGIPIEPSETDSAKDLFGGRLTSDMIAERQGHSNFKQMQELNWTSSSISCIYFV

SEQ ID NO: 45774 - protein, 112 aa, Homo sapiens
  Payload ID: 9344
  Gene Symbol: LRRC9
  Gene Name: leucine rich repeat containing 9
  ENSP ID: ENSP00000457559
  MOD_RES (1)..(1): Any amino acid
XLVKLEKLFLGYNKIQDITELEKLDVISTLRELTVYGNPICRKMLHRHMLIFRLPNLQMLDGSPVNSDDRAKAEFHLAELQAKKNSRSNIIRMLWFEKKRGWREKGNQLRGF

SEQ ID NO: 45775 - protein, 114 aa, Homo sapiens
  Payload ID: 9344
  Gene Symbol: LRRC9
  Gene Name: leucine rich repeat containing 9
  ENSP ID: ENSP00000457773
MIESENLNQEEIIKELCLCNGLSYEMVGQEGSDTSKLEMFFLGYPRIVGLSLFPNLTSLTIVAQDIKEISGLEPCLQLKELWIAECCIEKIEGLQECRNLEKLYLYFNKISKIE

SEQ ID NO: 45776 - protein, 716 aa, Homo sapiens
  Payload ID: 9345
  Gene Symbol: LRRN1
  Gene Name: leucine rich repeat neuronal 1
  Uniprot ID: Q6UXK5
  ENSP ID: ENSP00000314901
MARMSFVIAACQLVLGLLMTSLTESSIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVPQLALQKVPNLKFLDLNKNPIHKIQEGDFKNMLRLKELGINNMGELVSVDRYALDNLPELTKLEATNNPKLSYIHRLAFRSVPALESLMLNNNALNAIYQKTVESLPNLREISIHSNPLRCDCVIHWINSNKTNIRFMEPLSMFCAMPPEYKGHQVKEVLIQDSSEQCLPMISHDSFPNRLNVDIGTTVFLDCRAMAEPEPEIYWVTPIGNKITVETLSDKYKLSSEGTLEISNIQIEDSGRYTCVAQNVQGADTRVATIKVNGTLLDGTQVLKIYVKQTESHSILVSWKVNSNVMTSNLKWSSATMKIDNPHITYTARVPVDVHEYNLTHLQPSTDYEVCLTVSNIHQQTQKSCVNVTTKNAAFAVDISDQETSTALAAVMGSMFAVISLASIAVYFAKRFKRKNYHHSLKKYMQKTSSIPLNELYPPLINLWEGDSEKDKDGSADTKPTQVDTSRSYYMW

SEQ ID NO: 45777 - protein, 713 aa, Homo sapiens
  Payload ID: 9346
  Gene Symbol: LRRN2
  Gene Name: leucine rich repeat neuronal 2
  Uniprot ID: O75325
  ENSP ID: ENSP00000356143
MRLLVAPLLLAWVAGATAAVPVVPWHVPCPPQCACQIRPWYTPRSSYREATTVDCNDLFLTAVPPALPAGTQTLLLQSNSIVRVDQSELGYLANLTELDLSQNSFSDARDCDFHALPQLLSLHLEENQLTRLEDHSFAGLASLQELYLNHNQLYRIAPRAFSGLSNLLRLHLNSNLLRAIDSRWFEMLPNLEILMIGGNKVDAILDMNFRPLANLRSLVLAGMNLREISDYALEGLQSLESLSFYDNQLARVPRRALEQVPGLKFLDLNKNPLQRVGPGDFANMLHLKELGLNNMEELVSIDKFALVNLPELTKLDITNNPRLSFIHPRAFHHLPQMETLMLNNNALSALHQQTVESLPNLQEVGLHGNPIRCDCVIRWANATGTRVRFIEPQSTLCAEPPDLQRLPVREVPFREMTDHCLPLISPRSFPPSLQVASGESMVLHCRALAEPEPEIYWVTPAGLRLTPAHAGRRYRVYPEGTLELRRVTAEEAGLYTCVAQNLVGADTKTVSVVVGRALLQPGRDEGQGLELRVQETHPYHILLSWVTPPNTVSTNLTWSSASSLRGQGATALARLPRGTHSYNITRLLQATEYWACLQVAFADAHTQLACVWARTKEATSCHRALGDRPGLIAILALAVLLLAAGLAAHLGTGQPRKGVGGRRPLPPAWAFWGWSAPSVRVVSAPLVLPWNPGRKLPRSSEGETLLPPLSQNS

SEQ ID NO: 45778 - protein, 713 aa, Homo sapiens; identical to SEQ ID NO: 45777
  Payload ID: 9346
  Gene Symbol: LRRN2
  Gene Name: leucine rich repeat neuronal 2
  Uniprot ID: O75325
  ENSP ID: ENSP00000356144

SEQ ID NO: 45779 - protein, 713 aa, Homo sapiens; identical to SEQ ID NO: 45777
  Payload ID: 9346
  Gene Symbol: LRRN2
  Gene Name: leucine rich repeat neuronal 2
  Uniprot ID: O75325
  ENSP ID: ENSP00000356145

SEQ ID NO: 45780 - protein, 708 aa, Homo sapiens
  Payload ID: 9347
  Gene Symbol: LRRN3
  Gene Name: leucine rich repeat neuronal 3
  Uniprot ID: Q9H3W5
  ENSP ID: ENSP00000312001
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPINRIRRGDFSNMLHLKELGINNMPELISIDSLAVDNLPDLRKIEATNNPRLSYIHPNAFFRLPKLESLMLNSNALSALYHGTIESLPNLKEISIHSNPIRCDCVIRWMNMNKTNIRFMEPDSLFCVDPPEFQGQNVRQVHFRDMMEICLPLIAPESFPSNLNVEAGSYVSFHCRATAEPQPEIYWITPSGQKLLPNTLTDKFYVHSEGTLDINGVTPKEGGLYTCIATNLVGADLKSVMIKVDGSFPQDNNGSLNIKIRDIQANSVLVSWKASSKILKSSVKWTAFVKTENSHAAQSARIPSDVKVYNLTHLNPSTEYKICIDIPTIYQKNRKKCVNVTTKGLHPDQKEYEKNNTTTLMACLGGLLGIIGVICLISCLSPEMNCDGGHSYVRNYLQKPTFALGELYPPLINLWEAGKEKSTSLKVKATVIGLPTNMS

SEQ ID NO: 45781 - protein, 708 aa, Homo sapiens; identical to SEQ ID NO: 45780
  Payload ID: 9347
  Gene Symbol: LRRN3
  Gene Name: leucine rich repeat neuronal 3
  Uniprot ID: Q9H3W5
  ENSP ID: ENSP00000397312

SEQ ID NO: 45782 - protein, 273 aa, Homo sapiens
  Payload ID: 9347
  Gene Symbol: LRRN3
  Gene Name: leucine rich repeat neuronal 3
  ENSP ID: ENSP00000407927
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPIN

SEQ ID NO: 45783 - protein, 708 aa, Homo sapiens; identical to SEQ ID NO: 45780
  Payload ID: 9347
  Gene Symbol: LRRN3
  Gene Name: leucine rich repeat neuronal 3
  Uniprot ID: Q9H3W5
  ENSP ID: ENSP00000412417

SEQ ID NO: 45784 - protein, 740 aa, Homo sapiens
  Payload ID: 9348
  Gene Symbol: LRRN4
  Gene Name: leucine rich repeat neuronal 4
  Uniprot ID: Q8WUT4
  ENSP ID: ENSP00000368135
MRQTLPLLLLTVLRPSWADPPQEKVPLFRVTQQGPWGSSGSNATDSPCEGLPAADATALTLANRNLERLPGCLPRTLRSLDASHNLLRALSTSELGHLEQLQVLTLRHNRIAALRWGPGGPAGLHTLDLSYNQLAALPPCTGPALSSLRALALAGNPLRALQPRAFACFPALQLLNLSCTALGRGAQGGIAEAAFAGEDGAPLVTLEVLDLSGTFLERVESGWIRDLPKLTSLYLRKMPRLTTLEGDIFKMTPNLQQLDCQDSPALASVATHIFQDTPHLQVLLFQNCNLSSFPPWTLDSSQVLSINLFGNPLTCSCDLSWLLTDAKRTVLSRAADTMCAPAAGSSGPFSASLSLSQLPGVCQSDQSTTLGASHPPCFNRSTYAQGTTVAPSAAPATRPAGDQQSVSKAPNVGSRTIAAWPHSDAREGTAPSTTNSVAGHSNSSVFPRAASTTRTQHRGEHAPELVLEPDISAASTPLASKLLGPFPTSWDRSISSPQPGQRTHATPQAPNPSLSEGEIPVLLLDDYSEEEEGRKEEVGTPHQDVPCDYHPCKHLQTPCAELQRRWRCRCPGLSGEDTIPDPPRLQGVTETTDTSALVHWCAPNSVVHGYQIRYSAEGWAGNQSVVGVIYATARQHPLYGLSPGTTYRVCVLAANRAGLSQPRSSGWRSPCAAFTTKPSFALLLSGLCAASGLLLASTVVLSACLCRRGQTLGLQRCDTHLVAYKNPAFDDYPLGLQTVS

SEQ ID NO: 45785 - protein, 414 aa, Homo sapiens
  Payload ID: 9349
  Gene Symbol: LRR1
  Gene Name: leucine rich repeat protein 1
  Uniprot ID: Q96L50
  ENSP ID: ENSP00000298288
MKLHCEVEVISRHLPALGLRNRGKGVRAVLSLCQQTSRSQPPVRAFLLISTLKDKRGTRYELRENIEQFFTKFVDEGKATVRLKEPPVDICLSKAISSSLKGFLSAMRLAHRGCNVDTPVSTLTPVKTSEFENFKTKMVITSKKDYPLSKNFPYSLEHLQTSYCGLVRVDMRMLCLKSLRKLDLSHNHIKKLPATIGDLIHLQELNLNDNHLESFSVALCHSTLQKSLRSLDLSKNKIKALPVQFCQLQELKNLKLDDNELIQFPCKIGQLINLRFLSAARNKLPFLPSEFRNLSLEYLDLFGNTFEQPKVLPVIKLQAPLTLLESSARTILHNRIPYGSHIIPFHLCQDLDTAKICVCGRFCLNSFIQGTTTMNLHSVAHTVVLVDNLGGTEAPIISYFCSLGCYVNSSDMLK

SEQ ID NO: 45786 - protein, 146 aa, Homo sapiens
  Payload ID: 9349
  Gene Symbol: LRR1
  Gene Name: leucine rich repeat protein 1
  Uniprot ID: Q96L50
  ENSP ID: ENSP00000315628
MKLHCEVEVISRHLPALGLRNRGKGVRAVLSLCQQTSRSQPPVRAFLLISTLKDKRGTRYELRENIEQFFTKFVDEGKATVRLKEPPVDICLSKDSIWLSYHSIPSLPRFGYRKNLCLWKILSELFHSRNYYHESAFCCPHCGLSR

SEQ ID NO: 45787 - protein, 64 aa, Homo sapiens
  Payload ID: 9349
  Gene Symbol: LRR1
  Gene Name: leucine rich repeat protein 1
  ENSP ID: ENSP00000439452
MKLHCEVEVISRHLPALGLRNRGKGVRAVLSLCQQTSRSQPPVRAFLLISTLKDKRGTRYEHSG

SEQ ID NO: 45788 - protein, 133 aa, Homo sapiens
  Payload ID: 9349
  Gene Symbol: LRR1
  Gene Name: leucine rich repeat protein 1
  ENSP ID: ENSP00000452355
MKLHCEVEVISRHLPALGLRNRGKGVRAVLSLCQQTSRSQPPVRAFLLISTLKDKRGTRYELRENIEQFFTKFVDEGKATVRLKEPPVDICLSKMESHSVTQVGVQWEELGSLQPTGHFQQFKRFPFSYETGS

SEQ ID NO: 45789 - protein, 522 aa, Homo sapiens
  Payload ID: 9350
  Gene Symbol: LRRTM1
  Gene Name: leucine rich repeat transmembrane neuronal 1
  Uniprot ID: Q86UE6
  ENSP ID: ENSP00000295057
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVKVNFAHFPRLISLHSLCLRRNKVAIVVSSLDWVWNLEKMDLSGNEIEYMEPHVFETVPHLQSLQLDSNRLTYIEPRILNSWKSLTSITLAGNLWDCGRNVCALASWLNNFQGRYDGNLQCASPEYAQGEDVLDAVYAFHLCEDGAEPTSGHLLSAVTNRSDLGPPASSATTLADGGEGQHDGTFEPATVALPGGEHAENAVQIHKVVTGTMALIFSFLIVVLVLYVSWKCFPASLRQLRQCFVTQRRKQKQKQTMHQMAAMSAQEYYVDYKPNHIEGALVIINEYGSCTCHQQPARECEV

SEQ ID NO: 45790 - protein, 522 aa, Homo sapiens; identical to SEQ ID NO: 45789
  Payload ID: 9350
  Gene Symbol: LRRTM1
  Gene Name: leucine rich repeat transmembrane neuronal 1
  Uniprot ID: Q86UE6
  ENSP ID: ENSP00000386646

SEQ ID NO: 45791 - protein, 183 aa, Homo sapiens
  Payload ID: 9350
  Gene Symbol: LRRTM1
  Gene Name: leucine rich repeat transmembrane neuronal 1
  ENSP ID: ENSP00000389473
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQD

SEQ ID NO: 45792 - protein, 522 aa, Homo sapiens; identical to SEQ ID NO: 45789
  Payload ID: 9350
  Gene Symbol: LRRTM1
  Gene Name: leucine rich repeat transmembrane neuronal 1
  Uniprot ID: Q86UE6
  ENSP ID: ENSP00000393562

SEQ ID NO: 45793 - protein, 109 aa, Homo sapiens
  Payload ID: 9350
  Gene Symbol: LRRTM1
  Gene Name: leucine rich repeat transmembrane neuronal 1
  ENSP ID: ENSP00000404557
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAF

SEQ ID NO: 45794 - protein, 522 aa, Homo sapiens; identical to SEQ ID NO: 45789
  Payload ID: 9350
  Gene Symbol: LRRTM1
  Gene Name: leucine rich repeat transmembrane neuronal 1
  Uniprot ID: Q86UE6
  ENSP ID: ENSP00000414523

SEQ ID NO: 45795 - protein, 223 aa, Homo sapiens
  Payload ID: 9350
  Gene Symbol: LRRTM1
  Gene Name: leucine rich repeat transmembrane neuronal 1
  ENSP ID: ENSP00000415368
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVK

SEQ ID NO: 45796 - protein, 516 aa, Homo sapiens
  Payload ID: 9351
  Gene Symbol: LRRTM2
  Gene Name: leucine rich repeat transmembrane neuronal 2
  Uniprot ID: O43300
  ENSP ID: ENSP00000274711
MGLHFKWPLGAPMLAAIYAMSMVLKMLPALGMACPPKCRCEKLLFYCDSQGFHSVPNATDKGSLGLSLRHNHITELERDQFASFSQLTWLHLDHNQISTVKEDAFQGLYKLKELILSSNKIFYLPNTTFTQLINLQNLDLSFNQLSSLHPELFYGLRKLQTLHLRSNSLRTIPVRLFWDCRSLEFLDLSTNRLRSLARNGFAGLIKLRELHLEHNQLTKINFAHFLRLSSLHTLFLQWNKISNLTCGMEWTWGTLEKLDLTGNEIKAIDLTVFETMPNLKILLMDNNKLNSLDSKILNSLRSLTTVGLSGNLWECSARICALASWLGSFQGRWEHSILCHSPDHTQGEDILDAVHGFQLCWNLSTTVTVMATTYRDPTTEYTKRISSSSYHVGDKEIPTTAGIAVTTEEHFPEPDNAIFTQRVITGTMALLFSFFFIIFIVFISRKCCPPTLRRIRQCSMVQNHRQLRSQTRLHMSNMSDQGPYNEYEPTHEGPFIIINGYGQCKCQQLPYKECEV

SEQ ID NO: 45797 - protein, 38 aa, Homo sapiens
  Payload ID: 9351
  Gene Symbol: LRRTM2
  Gene Name: leucine rich repeat transmembrane neuronal 2
  ENSP ID: ENSP00000428398
MAVISAPRALLWPSEAADLAFTFQLPADYPSTPVLGLS

SEQ ID NO: 45798 - protein, 77 aa, Homo sapiens
  Payload ID: 9351
  Gene Symbol: LRRTM2
  Gene Name: leucine rich repeat transmembrane neuronal 2
  ENSP ID: ENSP00000430902
MVFISRKCCPPTLRRIRQCSMVQNHRQLRSQTRLHMSNMSDQGPYNEYEPTHEGPFIIINGYGQCKCQQLPYKECEV

SEQ ID NO: 45799 - protein, 581 aa, Homo sapiens
  Payload ID: 9352
  Gene Symbol: LRRTM3
  Gene Name: leucine rich repeat transmembrane neuronal 3
  Uniprot ID: Q86VH5
  ENSP ID: ENSP00000355187
MGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHKIIAGSVALFLSVLVILLVIYVSWKRYPASMKQLQQRSLMRRHRKKKRQSLKQMTPSTQEFYVDYKPTNTETSEMLLNGTGPCTYNKSGSRECEIPLSMNVSTFLAYDQPTISYCGVHHELLSHKSFETNAQEDTMETHLETELDLSTITTAGRISDHKQQLA

SEQ ID NO: 45800 - protein, 518 aa, Homo sapiens
  Payload ID: 9353
  Gene Symbol: LRRTM4
  Gene Name: leucine rich repeat transmembrane neuronal 4
  Uniprot ID: Q86VH4
  ENSP ID: ENSP00000386236
MGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEV

SEQ ID NO: 45801 - protein, 519 aa, Homo sapiens
  Payload ID: 9353
  Gene Symbol: LRRTM4
  Gene Name: leucine rich repeat transmembrane neuronal 4
  ENSP ID: ENSP00000386286
MPGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEV

SEQ ID NO: 45802 - protein, 590 aa, Homo sapiens
  Payload ID: 9353
  Gene Symbol: LRRTM4
  Gene Name: leucine rich repeat transmembrane neuronal 4
  Uniprot ID: Q86VH4
  ENSP ID: ENSP00000386357
MGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEMPHHMKPLPYYSYDQPVIGYCQAHQPLHVTKGYETVSPEQDESPGLELGRDHSFIATIARSAAPAIYLERIAN

SEQ ID NO: 45803 - protein, 591 aa, Homo sapiens
  Payload ID: 9353
  Gene Symbol: LRRTM4
  Gene Name: leucine rich repeat transmembrane neuronal 4
  ENSP ID: ENSP00000387228
MPGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEMPHHMKPLPYYSYDQPVIGYCQAHQPLHVTKGYETVSPEQDESPGLELGRDHSFIATIARSAAPAIYLERIAN

SEQ ID NO: 45804 - protein, 590 aa, Homo sapiens; identical to SEQ ID NO: 45802
  Payload ID: 9353
  Gene Symbol: LRRTM4
  Gene Name: leucine rich repeat transmembrane neuronal 4
  Uniprot ID: Q86VH4
  ENSP ID: ENSP00000387297

SEQ ID NO: 45805 - protein, 24 aa, Homo sapiens
  Payload ID: 9353
  Gene Symbol: LRRTM4
  Gene Name: leucine rich repeat transmembrane neuronal 4
  ENSP ID: ENSP00000408722
MSVVLVLLPTLLLVMLTGAQRACP

SEQ ID NO: 45806 - protein, 192 aa, Homo sapiens
  Payload ID: 9354
  Gene Symbol: LRTOMT
  Gene Name: leucine rich transmembrane and O-methyltransferase domain containing
  Uniprot ID: Q96E66
  ENSP ID: ENSP00000289488
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYRQYVLCTLSRITTFDFSGVTKADRTTAEVWKRMNIKPKKAWTKQNTL

SEQ ID NO: 45807 - protein, 291 aa, Homo sapiens
  Payload ID: 9354
  Gene Symbol: LRTOMT
  Gene Name: leucine rich transmembrane and O-methyltransferase domain containing
  Uniprot ID: Q8WZ04
  ENSP ID: ENSP00000305742
MGTPWRKRKGIAGPGLPDLSCALVLQPRAQVGTMSPAIALAFLPLVVTLLVRYRHYFRLLVRTVLLRSLRDCLSGLRIEERAFSYVLTHALPGDPGHILTTLDHWSSRCEYLSHMGPVKGQILMRLVEEKAPACVLELGTYCGYSTLLIARALPPGGRLLTVERDPRTAAVAEKLIRLAGFDEHMVELIVGSSEDVIPCLRTQYQLSRADLVLLAHRPRCYLRDLQLLEAHALLPAGATVLADHVLFPGAPRFLQYAKSCGRYRCRLHHTGLPDFPAIKDGIAQLTYAGPG

SEQ ID NO: 45808 - protein, 47 aa, Homo sapiens
  Payload ID: 9354
  Gene Symbol: LRTOMT
  Gene Name: leucine rich transmembrane and O-methyltransferase domain containing
  ENSP ID: ENSP00000390485
MGTPWRKRKGIDGVSLCHTGWSAVARSWLTATSASQVQEILLPQPPQ

SEQ ID NO: 45809 - protein, 155 aa, Homo sapiens
  Payload ID: 9354
  Gene Symbol: LRTOMT
  Gene Name: leucine rich transmembrane and O-methyltransferase domain containing
  ENSP ID: ENSP00000392233
MGTPWRKRKGIAGPGLPDLSCALVLQPSLRDCLSGLRIEERAFSYVLTHALPGDPGHILTTLDHWSSRCEYLSHMGPVKGQILMRLVEEKPLLVCWNWEPTVDTLPCLLPEPCPLGVAFLLWSGTHARQQWLKNSSAWPALMSTWWSSSWAAQRT

SEQ ID NO: 45810 - protein, 156 aa, Homo sapiens
  Payload ID: 9354
  Gene Symbol: LRTOMT
  Gene Name: leucine rich transmembrane and O-methyltransferase domain containing
  ENSP ID: ENSP00000395139
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYRWSSSWAAQRT

SEQ ID NO: 45811 - protein, 227 aa, Homo sapiens
  Payload ID: 9354
  Gene Symbol: LRTOMT
  Gene Name: leucine rich transmembrane and O-methyltransferase domain containing
  Uniprot ID: Q96E66
  ENSP ID: ENSP00000409403
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYSRPWTPRPVLCSGPPAQGPGRDHVPCHCIGLPATGGNIAGAVPALLPIAGAHGLAAKPPRLPVRAADRGAGLQLRAHPCPAR

SEQ ID NO: 45812 - protein, 291 aa, Homo sapiens; identical to SEQ ID NO: 45807
  Payload ID: 9354
  Gene Symbol: LRTOMT
  Gene Name: leucine rich transmembrane and O-methyltransferase domain containing
  Uniprot ID: Q8WZ04
  ENSP ID: ENSP00000409789

SEQ ID NO: 45813 - protein, 192 aa, Homo sapiens; identical to SEQ ID NO: 45806
  Payload ID: 9354
  Gene Symbol: LRTOMT
  Gene Name: leucine rich transmembrane and O-methyltransferase domain containing
  Uniprot ID: Q96E66
  ENSP ID: ENSP00000414271

SEQ ID NO: 45814 - protein, 38 aa, Homo sapiens
  Payload ID: 9354
  Gene Symbol: LRTOMT
  Gene Name: leucine rich transmembrane and O-methyltransferase domain containing
  ENSP ID: ENSP00000437561
MNKRDYMNTSVQEPPLDYSFRSIHVIQANLKGNRGLSQ

SEQ ID NO: 45815 - protein, 43 aa, Homo sapiens
  Payload ID: 9354
  Gene Symbol: LRTOMT
  Gene Name: leucine rich transmembrane and O-methyltransferase domain containing
  ENSP ID: ENSP00000437649
MGTPWRKRKGIGNMCCAPCPVSPRSTSVGSPKQTAPQLKSGNA

SEQ ID NO: 45816 - protein, 65 aa, Homo sapiens
  Payload ID: 9354
  Gene Symbol: LRTOMT
  Gene Name: leucine rich transmembrane and O-methyltransferase domain containing
  ENSP ID: ENSP00000437985
MNKRDYMNTSVQEPPLDYSFRSIHVIQGQPPEHSTPLTKAAGPVWSLGRNHNLLKSLKRFFPYAC

SEQ ID NO: 45817 - protein, 158 aa, Homo sapiens
  Payload ID: 9354
  Gene Symbol: LRTOMT
  Gene Name: leucine rich transmembrane and O-methyltransferase domain containing
  Uniprot ID: Q96E66
  ENSP ID: ENSP00000438522
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYRVPGSVEMPHRPP

SEQ ID NO: 45818 - protein, 92 aa, Homo sapiens
  Payload ID: 9354
  Gene Symbol: LRTOMT
  Gene Name: leucine rich transmembrane and O-methyltransferase domain containing
  ENSP ID: ENSP00000438762
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLT

SEQ ID NO: 45819 - protein, 103 aa, Homo sapiens
  Payload ID: 9354
  Gene Symbol: LRTOMT
  Gene Name: leucine rich transmembrane and O-methyltransferase domain containing
  ENSP ID: ENSP00000440248
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFN

SEQ ID NO: 45820 - protein, 146 aa, Homo sapiens
  Payload ID: 9354
  Gene Symbol: LRTOMT
  Gene Name: leucine rich transmembrane and O-methyltransferase domain containing
  Uniprot ID: Q96E66
  ENSP ID: ENSP00000440693
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYR

SEQ ID NO: 45821 - protein, 187 aa, Homo sapiens
  Payload ID: 9354
  Gene Symbol: LRTOMT
  Gene Name: leucine rich transmembrane and O-methyltransferase domain containing
  Uniprot ID: Q96E66
  ENSP ID: ENSP00000440969
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYSRPWTPRPVLCSGPPAQPPRLPVRAADRGAGLQLRAHPCPAR

SEQ ID NO: 45822 - protein, 174 aa, Homo sapiens
  Payload ID: 9354
  Gene Symbol: LRTOMT
  Gene Name: leucine rich transmembrane and O-methyltransferase domain containing
  Uniprot ID: Q96E66
  ENSP ID: ENSP00000441249
MVEFQPSVTDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYRQYVLCTLSRITTFDFSGVTKADRTTAEVWKRMNIKPKKAWTKQNTL

SEQ ID NO: 45823 - protein, 43 aa, Homo sapiens; identical to SEQ ID NO: 45815
  Payload ID: 9354
  Gene Symbol: LRTOMT
  Gene Name: leucine rich transmembrane and O-methyltransferase domain containing
  ENSP ID: ENSP00000442267

SEQ ID NO: 45824 - protein, 146 aa, Homo sapiens; identical to SEQ ID NO: 45820
  Payload ID: 9354
  Gene Symbol: LRTOMT
  Gene Name: leucine rich transmembrane and O-methyltransferase domain containing
  Uniprot ID: Q96E66
  ENSP ID: ENSP00000443421

SEQ ID NO: 45825 - protein, 192 aa, Homo sapiens; identical to SEQ ID NO: 45806
  Payload ID: 9354
  Gene Symbol: LRTOMT
  Gene Name: leucine rich transmembrane and O-methyltransferase domain containing
  Uniprot ID: Q96E66
  ENSP ID: ENSP00000444583

SEQ ID NO: 45826 - protein, 174 aa, Homo sapiens; identical to SEQ ID NO: 45822
  Payload ID: 9354
  Gene Symbol: LRTOMT
  Gene Name: leucine rich transmembrane and O-methyltransferase domain containing
  Uniprot ID: Q96E66
  ENSP ID: ENSP00000482923

SEQ ID NO: 45827 - protein, 168 aa, Homo sapiens
  Payload ID: 9355
  Gene Symbol: LEUTX
  Gene Name: leucine twenty homeobox
  Uniprot ID: A8MZ59
  ENSP ID: ENSP00000380053
MHPSLATMGKLASKLQLDLSVVKIWFKNQRAKWKRQQRQQMQTRPSLGPANQTTSVKKEETPSAITTANIRPVSPGISDANDHDLREPSGIKNPGGASASARVSSWDSQSYDIEQICLGASNPPWASTLFEIDEFVKIYDLPGEDDTSSLNQYLFPVCLEYDQLQSSV

SEQ ID NO: 45828 - protein, 168 aa, Homo sapiens; identical to SEQ ID NO: 45827
  Payload ID: 9355
  Gene Symbol: LEUTX
  Gene Name: leucine twenty homeobox
  Uniprot ID: A8MZ59
  ENSP ID: ENSP00000486698

SEQ ID NO: 45829 - protein, 190 aa, Homo sapiens
  Payload ID: 9356
  Gene Symbol: LZIC
  Gene Name: leucine zipper and CTNNBIP1 domain containing
  Uniprot ID: Q8WZA0
  ENSP ID: ENSP00000366418
MASRGKTETSKLKQNLEEQLDRLMQQLQDLEECREELDTDEYEETKKETLEQLSEFNDSLKKIMSGNMTLVDELSGMQLAIQAAISQAFKTPEVIRLFAKKQPGQLRTRLAEMDRDLMVGKLERDLYTQQKVEILTALRKLGEKLTADDEAFLSANAGAILSQFEKVSTDLGSGDKILALASFEVEKTKK

SEQ ID NO: 45830 - protein, 190 aa, Homo sapiens; identical to SEQ ID NO: 45829
  Payload ID: 9356
  Gene Symbol: LZIC
  Gene Name: leucine zipper and CTNNBIP1 domain containing
  Uniprot ID: Q8WZA0
  ENSP ID: ENSP00000366430

SEQ ID NO: 45831 - protein, 190 aa, Homo sapiens; identical to SEQ ID NO: 45829
  Payload ID: 9356
  Gene Symbol: LZIC
  Gene Name: leucine zipper and CTNNBIP1 domain containing
  Uniprot ID: Q8WZA0
  ENSP ID: ENSP00000383695

SEQ ID NO: 45832 - protein, 169 aa, Homo sapiens
  Payload ID: 9356
  Gene Symbol: LZIC
  Gene Name: leucine zipper and CTNNBIP1 domain containing
  ENSP ID: ENSP00000468610
LDTDEYEETKKETLEQLSEFNDSLKKIMSGNMTLVDELSGMQLAIQAAISQAFKTPEVIRLFAKKQPGQLRTRLAEMDRDLMVGKLERDLYTQQKVEILTALRKLGEKLTADDEAFLSANAGAILSQFEKVSTDLGRPPSYMNYLLDSHPSKNIDVPSKISFLLKIQDL

SEQ ID NO: 45833 - protein, 1076 aa, Homo sapiens
  Payload ID: 9357
  Gene Symbol: LUZP1
  Gene Name: leucine zipper protein 1
  Uniprot ID: Q86V48
  ENSP ID: ENSP00000303758
MAEFTSYKETASSRHLRFKLQSLSRRLDELEEATKNLQKAEDELLDLQDKVIQAEGSNSSMLAEIEVLRQRVLRIEGKDEEIKRAEDLCRLMKEKLEEEENLTRELKSEIERLQKRMAELEKLEEAFSRSKNDCTQLCLSLNEERNLTKKISSELEMLRVKVKELESSEDRLDKTEQSLASELEKLKSLTLSFVSERKYLNEKEKENEKLIKELTQKLEQNKKMNRDYTRNASNLERNDLRIEDGISSTLPSKESRRKGGLDYLKQVENETRNKSENEKNRNQEDNKVKDLNQEIEKLKTQIKHFESLEEELKKMKSKNNDLQDNYLSEQNKNKLLASQLEEIKLQIKKQKELENGEVEGEDAFLSSKGRHERTKFRGHGSEASVSKHTARELSPQHKRERLRNREFALNNENYSLSNRQVSSPSFTNRRAAKASHMGVSTDSGTQETKKTEDRFVPGSSQSEGKKSREQPSVLSRYPPAAQEHSKAWKGTSKPGTESGLKGKVEKTTRTFSDTTHGSVPSDPLGRADKASDTSSETVFGKRGHVLGNGSQVTQAANSGCSKAIGALASSRRSSSEGLSKGKKAANGLEADNSCPNSKAPVLSKYPYSCRSQENILQGFSTSHKEGVNQPAAVVMEDSSPHEALRCRVIKSSGREKPDSDDDLDIASLVTAKLVNTTITPEPEPKPQPNSREKAKTRGAPRTSLFENDKDAGMENESVKSVRASTNTMELPDTNGAGVKSQRPFSPREALRSRAIIKPVIVDKDVKKIMGGSGTETTLEKQKPVSKPGPNKVTSSITIYPSDSSSPRAAPGEALRERHTSTSNIQVGLAELTSVSNHVSSPFELSIHKHDITLQLAEAERMADGPLKDRPETVVSRSSIIIKPSDPVERNSHAPPAETIRWKSHSAPSEVGFSDARHVTVRNAWKSRRDLKSLEDPPTRIGKNVESTNSNAYTQRSSTDFSELEQPRSCLFEQGTRRVGPSSGDAPEPSSRRTQSSLTVSEVLTRRNRVGDTITVAAWNHSASMEEEGEDCTLSVYRQLHNSLDPSELPGKQGLPESGRVRAEERLRPTRPCAEEN

SEQ ID NO: 45834 - protein, 1026 aa, Homo sapiens
  Payload ID: 9357
  Gene Symbol: LUZP1
  Gene Name: leucine zipper protein 1
  Uniprot ID: Q86V48
  ENSP ID: ENSP00000313705
MAEFTSYKETASSRHLRFKLQSLSRRLDELEEATKNLQKAEDELLDLQDKVIQAEGSNSSMLAEIEVLRQRVLRIEGKDEEIKRAEDLCRLMKEKLEEEENLTRELKSEIERLQKRMAELEKLEEAFSRSKNDCTQLCLSLNEERNLTKKISSELEMLRVKVKELESSEDRLDKTEQSLASELEKLKSLTLSFVSERKYLNEKEKENEKLIKELTQKLEQNKKMNRDYTRNASNLERNDLRIEDGISSTLPSKESRRKGGLDYLKQVENETRNKSENEKNRNQEDNKVKDLNQEIEKLKTQIKHFESLEEELKKMKSKNNDLQDNYLSEQNKNKLLASQLEEIKLQIKKQKELENGEVEGEDAFLSSKGRHERTKFRGHGSEASVSKHTARELSPQHKRERLRNREFALNNENYSLSNRQVSSPSFTNRRAAKASHMGVSTDSGTQETKKTEDRFVPGSSQSEGKKSREQPSVLSRYPPAAQEHSKAWKGTSKPGTESGLKGKVEKTTRTFSDTTHGSVPSDPLGRADKASDTSSETVFGKRGHVLGNGSQVTQAANSGCSKAIGALASSRRSSSEGLSKGKKAANGLEADNSCPNSKAPVLSKYPYSCRSQENILQGFSTSHKEGVNQPAAVVMEDSSPHEALRCRVIKSSGREKPDSDDDLDIASLVTAKLVNTTITPEPEPKPQPNSREKAKTRGAPRTSLFENDKDAGMENESVKSVRASTNTMELPDTNGAGVKSQRPFSPREALRSRAIIKPVIVDKDVKKIMGGSGTETTLEKQKPVSKPGPNKVTSSITIYPSDSSSPRAAPGEALRERHTSTSNIQVGLAELTSVSNHVSSPFELSIHKHDITLQLAEAERMADGPLKDRPETVVSRSSIIIKPSDPVERNSHAPPAETIRWKSHSAPSEVGFSDARHVTVRNAWKSRRDLKSLEDPPTRIGKNVESTNSNAYTQRSSTDFSELEQPRSCLFEQGTRRVGPSSGDAPEPSSRRTQSSLTVSEVLTRRNRVGDTITVAAWNHSASMSS

SEQ ID NO: 45835 - protein, 1076 aa, Homo sapiens; identical to SEQ ID NO: 45833
  Payload ID: 9357
  Gene Symbol: LUZP1
  Gene Name: leucine zipper protein 1
  Uniprot ID: Q86V48
  ENSP ID: ENSP00000393460

SEQ ID NO: 45836 - protein, 273 aa, Homo sapiens
  Payload ID: 9357
  Gene Symbol: LUZP1
  Gene Name: leucine zipper protein 1
  ENSP ID: ENSP00000428061
MAEFTSYKETASSRHLRFKLQSLSRRLDELEEATKNLQKAEDELLDLQDKVIQAEGSNSSMLAEIEVLRQRVLRIEGKDEEIKRAEDLCRLMKEKLEEEENLTRELKSEIERLQKRMAELEKLEEAFSRSKNDCTQLCLSLNEERNLTKKISSELEMLRVKVKELESSEDRLDKTEQSLASELEKLKSLTLSFVSERKYLNEKEKENEKLIKELTQKLEQNKKMNRDYTRNASNLERNDLRIEDGISSTLPSKESRRKGGLDYLKQVENETRN

SEQ ID NO: 45837 - protein, 35 aa, Homo sapiens
  Payload ID: 9357
  Gene Symbol: LUZP1
  Gene Name: leucine zipper protein 1
  ENSP ID: ENSP00000429657
MAEFTSYKETASSRHLRFKLQSLSRRLDELEEATK

SEQ ID NO: 45838 - protein, 346 aa, Homo sapiens
  Payload ID: 9358
  Gene Symbol: LUZP2
  Gene Name: leucine zipper protein 2
  Uniprot ID: Q86TE4
  ENSP ID: ENSP00000336817
MKFSPAHYLLPLLPALVLSTRQDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNENKSLKNKLLSGNKLCGIHAEESKKIQAQLKELRYGKKDLLFKAQQLTDLEQKLAVAKNELEKAALDRESQMKAMKETVQLCLTSVFRDQPPPPLSLITSNPTRMLLPPRNIASKLPDAAAKSKPQQSASGNNESSQVESTKEGNPSTTACDSQDEGRPCSMKHKESPPSNATAETEPIPQKLQMPPCSECEVKKAPEKPLTSFEGMAAREEKIL

SEQ ID NO: 45839 - protein, 260 aa, Homo sapiens
  Payload ID: 9358
  Gene Symbol: LUZP2
  Gene Name: leucine zipper protein 2
  Uniprot ID: Q86TE4
  ENSP ID: ENSP00000432952
MKSLQEALQNQLKETSEKAEKHQATINFLKTEVERKSKMIRDLQNENKSLKNKLLSGNKLCGIHAEESKKIQAQLKELRYGKKDLLFKAQQLTDLEQKLAVAKNELEKAALDRESQMKAMKETVQLCLTSVFRDQPPPPLSLITSNPTRMLLPPRNIASKLPDAAAKSKPQQSASGNNESSQVESTKEGNPSTTACDSQDEGRPCSMKHKESPPSNATAETEPIPQKLQMPPCSECEVKKAPEKPLTSFEGMAAREEKIL

SEQ ID NO: 45840 - protein, 176 aa, Homo sapiens
  Payload ID: 9358
  Gene Symbol: LUZP2
  Gene Name: leucine zipper protein 2
  ENSP ID: ENSP00000437032
MKFSPAHYLLPLLPALVLSTRQDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEAQQLTDLEQKLAVAKNELEKAALDRESQMKAMKETVQLCLTSVF

SEQ ID NO: 45841 - protein, 260 aa, Homo sapiens; identical to SEQ ID NO: 45839
  Payload ID: 9358
  Gene Symbol: LUZP2
  Gene Name: leucine zipper protein 2
  Uniprot ID: Q86TE4
  ENSP ID: ENSP00000480441

SEQ ID NO: 45842 - protein, 313 aa, Homo sapiens
  Payload ID: 9359
  Gene Symbol: LUZP4
  Gene Name: leucine zipper protein 4
  Uniprot ID: Q9P127
  ENSP ID: ENSP00000360988
MASFRKLTLSEKVPPNHPSRKKVNFLDMSLDDIIIYKELEGTNAEEEKNKRQNHSKKESPSRQQSKAHRHRHRRGYSRCRSNSEEGNHDKKPSQKPSGFKSGQHPLNGQPLIEQEKCSDNYEAQAEKNQGQSEGNQHQSEGNPDKSEESQGQPEENHHSERSRNHLERSLSQSDRSQGQLKRHHPQYERSHGQYKRSHGQSERSHGHSERSHGHSERSHGHSERSHGHSKRSRSQGDLVDTQSDLIATQRDLIATQKDLIATQRDLIATQRDLIVTQRDLVATERDLINQSGRSHGQSERHQRYSTGKNTITT

SEQ ID NO: 45843 - protein, 78 aa, Homo sapiens
  Payload ID: 9359
  Gene Symbol: LUZP4
  Gene Name: leucine zipper protein 4
  ENSP ID: ENSP00000360989
MASFRKLTLSEKVPPNHPSRKKVNFLDMSLDDIIIYKELEGTNAEEEKNKRQNHSKKESPSRQQSKAHRHRHRRGEVQ

SEQ ID NO: 45844 - protein, 58 aa, Homo sapiens
  Payload ID: 9360
  Gene Symbol: LUZP6
  Gene Name: leucine zipper protein 6
  Uniprot ID: Q538Z0
  ENSP ID: ENSP00000468007
IKSVISYALYQVQTGSLPVYSSVLTKSPLQLQTVIYRLIVQIQHLNIPSSSSTHSSPF

SEQ ID NO: 45845 - protein, 673 aa, Homo sapiens
  Payload ID: 9361
  Gene Symbol:
  Gene Name: Leucine zipper putative tumor suppressor 3  [Source:UniProtKB/Swiss-Prot
  Acc:O60299]
  Uniprot ID: O60299
  ENSP ID: ENSP00000332123
MAKLETLPVRADPGRDPLLAFAPRPSELGPPDPRLAMGSVGSGVAHAQEFAMKSVGTRTGGGGSQGSFPGPRGSGSGASRERPGRYPSEDKGLANSLYLNGELRGSDHTDVCGNVVGSSGGSSSSGGSDKAPPQYREPSHPPKLLATSGKLDQCSEPLVRPSAFKPVVPKNFHSMQNLCPPQTNGTPEGRQGPGGLKGGLDKSRTMTPAGGSGSGLSDSGRNSLTSLPTYSSSYSQHLAPLSASTSHINRIGTASYGSGSGGSSGGGSGYQDLGTSDSGRASSKSGSSSSMGRPGHLGSGEGGGGGLPFAACSPPSPSALIQELEERLWEKEQEVAALRRSLEQSEAAVAQVLEERQKAWERELAELRQGCSGKLQQVARRAQRAQQGLQLQVLRLQQDKKQLQEEAARLMRQREELEDKVAACQKEQADFLPRIEETKWEVCQKAGEISLLKQQLKDSQADVSQKLSEIVGLRSQLREGRASLREKEEQLLSLRDSFSSKQASLELGEGELPAACLKPALTPVDPAEPQDALATCESDEAKMRRQAGVAAAASLVSVDGEAEAGGESGTRALRREVGRLQAELAAERRARERQGASFAEERRVWLEEKEKVIEYQKQLQLSYVEMYQRNQQLERRLRERGAAGGASTPTPQHGEEKKAWTPSRLERIESTEI

SEQ ID NO: 45846 - protein, 673 aa, Homo sapiens; identical to SEQ ID NO: 45845
  Payload ID: 9361
  Gene Symbol:
  Gene Name: Leucine zipper putative tumor suppressor 3  [Source:UniProtKB/Swiss-Prot
  Acc:O60299]
  Uniprot ID: O60299
  ENSP ID: ENSP00000338166

SEQ ID NO: 45847 - protein, 627 aa, Homo sapiens
  Payload ID: 9361
  Gene Symbol:
  Gene Name: Leucine zipper putative tumor suppressor 3  [Source:UniProtKB/Swiss-Prot
  Acc:O60299]
  ENSP ID: ENSP00000353496
MAKLETLPVRADPGRDPLLAFAPRPSELGPPDPRLAMGSVGSGVAHAQEFAMKSVGTRTGGGGSQGSFPGPRGSGSGASRERPGRYPSEDKGLANSLYLNGELRGSDHTDVCGNVVGSSGGSSSSGGSDKAPPQYREPSHPPKLLATSGKLDQCSEPLVRPSAFKPVVPKNFHSMQNLCPPQTNGTPEGRQGPGGLKGGLDKSRTMTPAGGSGSGLSDSGRNSLTSLPTYSSSYSQHLAPLSASTSHINRIGTASYGSGSGGSSGGGSGYQDLGTSDSGRASSKSGSSSSMGRPGHLGSGEGGGGGLPFAACSPPSPSALIQELEERLWEKEQEVAALRRSLEQSEAAVAQQDKKQLQEEAARLMRQREELEDKVAACQKEQADFLPRIEETKWEVCQKAGEISLLKQQLKDSQADVSQKLSEIVGLRSQLREGRASLREKEEQLLSLRDSFSSKQASLELGEGELPAACLKPALTPVDPAEPQDALATCESDEAKMRRQAGVAAAASLVSVDGEAEAGGESGTRALRREVGRLQAELAAERRARERQGASFAEERRVWLEEKEKVIEYQKQLQLSYVEMYQRNQQLERRLRERGAAGGASTPTPQHGEEKKAWTPSRLERIESTEI

SEQ ID NO: 45848 - protein, 299 aa, Homo sapiens
  Payload ID: 9362
  Gene Symbol: LZTFL1
  Gene Name: leucine zipper transcription factor-like 1
  Uniprot ID: Q9NQ48
  ENSP ID: ENSP00000296135
MAELGLNEHHQNEVINYMRFARSKRGLRLKTVDSCFQDLKESRLVEDTFTIDEVSEVLNGLQAVVHSEVESELINTAYTNVLLLRQLFAQAEKWYLKLQTDISELENRELLEQVAEFEKAEITSSNKKPILDVTKPKLAPLNEGGTAELLNKEILRLQEENEKLKSRLKTIEIQATNALDEKSKLEKALQDLQLDQGNQKDFIKAQDLSNLENTVAALKSEFQKTLNDKTENQKSLEENLATAKHDLLRVQEQLHMAEKELEKKFQQTAAYRNMKEILTKKNDQIKDLRKRLAQYEPED

SEQ ID NO: 45849 - protein, 59 aa, Homo sapiens
  Payload ID: 9362
  Gene Symbol: LZTFL1
  Gene Name: leucine zipper transcription factor-like 1
  ENSP ID: ENSP00000397589
MKSLKSSMDYKLWFIVRWNLSSSTLPIPMCYFCDSCLHKLRSGILSYRQTSLNLKTENY

SEQ ID NO: 45850 - protein, 108 aa, Homo sapiens
  Payload ID: 9362
  Gene Symbol: LZTFL1
  Gene Name: leucine zipper transcription factor-like 1
  ENSP ID: ENSP00000400177
MHECPYQKEVLVSRTGLSSGLWVHRIITEKMISGGLPRFLLPRPTLTEPRRREGSHFWEAKTSVFQALAVSQPTFTDEEPRPREDGKAEKIHQVVPYPPFGDFSKKLG

SEQ ID NO: 45851 - protein, 90 aa, Homo sapiens
  Payload ID: 9362
  Gene Symbol: LZTFL1
  Gene Name: leucine zipper transcription factor-like 1
  ENSP ID: ENSP00000412240
MRFARSKRGLRLKTVDSCFQDLKESRLVEDTFTIDEVSEVLNGLQAVVHSEVESELINTAYTNVLLLRQLFAQAEKWYLKLQTDISELEN

SEQ ID NO: 45852 - protein, 235 aa, Homo sapiens
  Payload ID: 9362
  Gene Symbol: LZTFL1
  Gene Name: leucine zipper transcription factor-like 1
  ENSP ID: ENSP00000416083
  MOD_RES (1)..(1): Any amino acid
XLVEDTFTIDEVSEVLNGLQAVVHSEVESELINTAYTNVLLLRQLFAQAEKWYLKLQTDISELENRELLEQVAEFEKAEITSSNKKPILDVTKPKLAPLNEGGTAELLNKATNALDEKSKLEKALQDLQLDQGNQKDFIKAQDLSNLENTVAALKSEFQKTLNDKTENQKSLEENLATAKHDLLRVQEQLHMAEKELEKKFQQTAAYRNMKEILTKKNDQIKDLRKRLAQYEPED

SEQ ID NO: 45853 - protein, 108 aa, Homo sapiens; identical to SEQ ID NO: 45850
  Payload ID: 9362
  Gene Symbol: LZTFL1
  Gene Name: leucine zipper transcription factor-like 1
  ENSP ID: ENSP00000416427

SEQ ID NO: 45854 - protein, 282 aa, Homo sapiens
  Payload ID: 9362
  Gene Symbol: LZTFL1
  Gene Name: leucine zipper transcription factor-like 1
  Uniprot ID: Q9NQ48
  ENSP ID: ENSP00000439522
MRFARSKRGLRLKTVDSCFQDLKESRLVEDTFTIDEVSEVLNGLQAVVHSEVESELINTAYTNVLLLRQLFAQAEKWYLKLQTDISELENRELLEQVAEFEKAEITSSNKKPILDVTKPKLAPLNEGGTAELLNKEILRLQEENEKLKSRLKTIEIQATNALDEKSKLEKALQDLQLDQGNQKDFIKAQDLSNLENTVAALKSEFQKTLNDKTENQKSLEENLATAKHDLLRVQEQLHMAEKELEKKFQQTAAYRNMKEILTKKNDQIKDLRKRLAQYEPED

SEQ ID NO: 45855 - protein, 256 aa, Homo sapiens
  Payload ID: 9362
  Gene Symbol: LZTFL1
  Gene Name: leucine zipper transcription factor-like 1
  Uniprot ID: Q9NQ48
  ENSP ID: ENSP00000441784
MRNQDPGKMGRQRKSIKLYPTHPLVTFPRSWAKFQEKALLVEDTFTIDEVSEVLNGLQAVVHSEVESELINTAYTNVLLLRQLFAQAEKWYLKLQTDISELENRELLEQVAEFEKAEITSSNKKPILDVTKPKLAPLNEGGTAELLNKEILRLQEENEKLKSRLKTIEIQATNALDEKSKLEKALQDLQLDQGNQKDFIKAQDLSNLENTVAALKSEFQKTLNDKTENQKSLEENLATAKHDLLRVQEQLHMAEKI

SEQ ID NO: 45856 - protein, 146 aa, Homo sapiens
  Payload ID: 9363
  Gene Symbol: LDOC1
  Gene Name: leucine zipper, down-regulated in cancer 1
  Uniprot ID: O95751
  ENSP ID: ENSP00000359557
MVDELVLLLHALLMRHRALSIENSQLMEQLRLLVCERASLLRQVRPPSCPVPFPETFNGESSRLPEFIVQTASYMLVNENRFCNDAMKVAFLISLLTGEAEEWVVPYIEMDSPILGDYRAFLDEMKQCFGWDDDEDDDDEEEEDDY

SEQ ID NO: 45857 - protein, 239 aa, Homo sapiens
  Payload ID: 9364
  Gene Symbol: LDOC1L
  Gene Name: leucine zipper, down-regulated in cancer 1-like
  Uniprot ID: Q6ICC9
  ENSP ID: ENSP00000340434
MVQPQTSKAESPALAASPNAQMDDVIDTLTSLRLTNSALRREASTLRAEKANLTNMLESVMAELTLLRTRARIPGALQITPPISSITSNGTRPMTTPPTSLPEPFSGDPGRLAGFLMQMDRFMIFQASRFPGEAERVAFLVSRLTGEAEKWAIPHMQPDSPLRNNYQGFLAELRRTYKSPLRHARRAQIRKTSASNRAVRERQMLCRQLASAGTGPCPVHPASNGTSPAPALPARARNL

SEQ ID NO: 45858 - protein, 596 aa, Homo sapiens
  Payload ID: 9365
  Gene Symbol: LZTS1
  Gene Name: leucine zipper, putative tumor suppressor 1
  Uniprot ID: Q9Y250
  ENSP ID: ENSP00000265801
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHSTSSSYQLDPLVTPVGPTSRFGGSAHNITQGIVLQDSNMMSLKALSFSDGGSKLGHSNKADKGPSCVRSPISTDECSIQELEQKLLEREGALQKLQRSFEEKELASSLAYEERPRRCRDELEGPEPKGGNKLKQASQKSQRAQQVLHLQVLQLQQEKRQLRQELESLMKEQDLLETKLRSYEREKTSFGPALEETQWEVCQKSGEISLLKQQLKESQTEVNAKASEILGLKAQLKDTRGKLEGLELRTQDLEGALRTKGLELEVCENELQRKKNEAELLREKVNLLEQELQELRAQAALARDMGPPTFPEDVPALQRELERLRAELREERQGHDQMSSGFQHERLVWKEEKEKVIQYQKQLQQSYVAMYQRNQRLEKALQQLARGDSAGEPLEVDLEGADIPYEDIIATEI

SEQ ID NO: 45859 - protein, 596 aa, Homo sapiens; identical to SEQ ID NO: 45858
  Payload ID: 9365
  Gene Symbol: LZTS1
  Gene Name: leucine zipper, putative tumor suppressor 1
  Uniprot ID: Q9Y250
  ENSP ID: ENSP00000370981

SEQ ID NO: 45860 - protein, 537 aa, Homo sapiens
  Payload ID: 9365
  Gene Symbol: LZTS1
  Gene Name: leucine zipper, putative tumor suppressor 1
  Uniprot ID: Q9Y250
  ENSP ID: ENSP00000429263
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHSTSSSYQLDPLVTPVGPTSRFGGSAHNITQGIVLQDSNMMSLKALSFSDGGSKLGHSNKADKGPSCVRSPISTDECSIQELEQKLLEREGALQKLQRSFEEKELASSLAYEERPRRCRDELEGPEPKGGNKLKQASQKSQRAQQVLHLQVLQLQQEKRQLRQELESLMKEQDLLETKLRSYEREKTSFGPALEETQWEVCQKSGEISLLKQQLKESQTEVNAKASEILGLKAQLKDTRGKLEGLELRTQDLEGALRTKGLELEVCENELQRKKNEAELLREKHERLVWKEEKEKVIQYQKQLQQSYVAMYQRNQRLEKALQQLARGDSAGEPLEVDLEGADIPYEDIIATEI

SEQ ID NO: 45861 - protein, 76 aa, Homo sapiens
  Payload ID: 9365
  Gene Symbol: LZTS1
  Gene Name: leucine zipper, putative tumor suppressor 1
  Uniprot ID: Q9Y250
  ENSP ID: ENSP00000479534
MGSVSSLISGHSFHSKHCRASQYKLRKSSHLKKLNRYSDGLLRFGFSQDSGHGKAMTRCPRASSMSGSCGRRRRRR

SEQ ID NO: 45862 - protein, 669 aa, Homo sapiens
  Payload ID: 9366
  Gene Symbol: LZTS2
  Gene Name: leucine zipper, putative tumor suppressor 2
  Uniprot ID: Q9BRK4
  ENSP ID: ENSP00000359240
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDSGRSSSSKSTGSLGGRVAGGLLGSGTRASPDSSSCGERSPPPPPPPPSDEALLHCVLEGKLRDREAELQQLRDSLDENEATMCQAYEERQRHWQREREALREDCAAQAQRAQRAQQLLQLQVFQLQQEKRQLQDDFAQLLQEREQLERRCATLEREQRELGPRLEETKWEVCQKSGEISLLKQQLKESQAELVQKGSELVALRVALREARATLRVSEGRARGLQEAARARELELEACSQELQRHRQEAEQLREKAGQLDAEAAGLREPPVPPATADPFLLAESDEAKVQRAAAGVGGSLRAQVERLRVELQRERRRGEEQRDSFEGERLAWQAEKEQVIRYQKQLQHNYIQMYRRNRQLEQELQQLSLELEARELADLGLAEQAPCICLEEITATEI

SEQ ID NO: 45863 - protein, 669 aa, Homo sapiens; identical to SEQ ID NO: 45862
  Payload ID: 9366
  Gene Symbol: LZTS2
  Gene Name: leucine zipper, putative tumor suppressor 2
  Uniprot ID: Q9BRK4
  ENSP ID: ENSP00000359243

SEQ ID NO: 45864 - protein, 198 aa, Homo sapiens
  Payload ID: 9366
  Gene Symbol: LZTS2
  Gene Name: leucine zipper, putative tumor suppressor 2
  ENSP ID: ENSP00000402042
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSA

SEQ ID NO: 45865 - protein, 240 aa, Homo sapiens
  Payload ID: 9366
  Gene Symbol: LZTS2
  Gene Name: leucine zipper, putative tumor suppressor 2
  ENSP ID: ENSP00000407713
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTT

SEQ ID NO: 45866 - protein, 220 aa, Homo sapiens
  Payload ID: 9366
  Gene Symbol: LZTS2
  Gene Name: leucine zipper, putative tumor suppressor 2
  ENSP ID: ENSP00000416972
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDS

SEQ ID NO: 45867 - protein, 136 aa, Homo sapiens
  Payload ID: 9366
  Gene Symbol: LZTS2
  Gene Name: leucine zipper, putative tumor suppressor 2
  ENSP ID: ENSP00000474819
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEK

SEQ ID NO: 45868 - protein, 739 aa, Homo sapiens
  Payload ID: 9367
  Gene Symbol: LETM1
  Gene Name: leucine zipper-EF-hand containing transmembrane protein 1
  Uniprot ID: O95202
  ENSP ID: ENSP00000305653
MASILLRSCRGRAPARLPPPPRYTVPRGSPGDPAHLSCASTLGLRNCLNVPFGCCTPIHPVYTSSRGDHLGCWALRPECLRIVSRAPWTSTSVGFVAVGPQCLPVRGWHSSRPVRDDSVVEKSLKSLKDKNKKLEEGGPVYSPPAEVVVKKSLGQRVLDELKHYYHGFRLLWIDTKIAARMLWRILNGHSLTRRERRQFLRICADLFRLVPFLVFVVVPFMEFLLPVAVKLFPNMLPSTFETQSLKEERLKKELRVKLELAKFLQDTIEEMALKNKAAKGSATKDFSVFFQKIRETGERPSNEEIMRFSKLFEDELTLDNLTRPQLVALCKLLELQSIGTNNFLRFQLTMRLRSIKADDKLIAEEGVDSLNVKELQAACRARGMRALGVTEDRLRGQLKQWLDLHLHQEIPTSLLILSRAMYLPDTLSPADQLKSTLQTLPEIVAKEAQVKVAEVEGEQVDNKAKLEATLQEEAAIQQEHREKELQKRSEVAKDFEPERVVAAPQRPGTEPQPEMPDTVLQSETLKDTAPVLEGLKEEEITKEEIDILSDACSKLQEQKKSLTKEKEELELLKEDVQDYSEDLQEIKKELSKTGEEKYVEESKASKRLTKRVQQMIGQIDGLISQLEMDQQAGKLAPANGMPTGENVISVAELINAMKQVKHIPESKLTSLAAALDENKDGKVNIDDLVKVIELVDKEDVHISTSQVAEIVATLEKEEKVEEKEKAKEKAEKEVAEVKS

SEQ ID NO: 45869 - protein, 396 aa, Homo sapiens
  Payload ID: 9368
  Gene Symbol: LETM2
  Gene Name: leucine zipper-EF-hand containing transmembrane protein 2
  Uniprot ID: Q2VYF4
  ENSP ID: ENSP00000297720
MKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRREEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 45870 - protein, 491 aa, Homo sapiens
  Payload ID: 9368
  Gene Symbol: LETM2
  Gene Name: leucine zipper-EF-hand containing transmembrane protein 2
  Uniprot ID: Q2VYF4
  ENSP ID: ENSP00000369291
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRLLRTCVDFFRLVPFMVFLIVPFMEFLLPVFLKLFPEMLPSTFESESKKEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 45871 - protein, 444 aa, Homo sapiens
  Payload ID: 9368
  Gene Symbol: LETM2
  Gene Name: leucine zipper-EF-hand containing transmembrane protein 2
  Uniprot ID: Q2VYF4
  ENSP ID: ENSP00000428765
MKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRLLRTCVDFFRLVPFMVFLIVPFMEFLLPVFLKLFPEMLPSTFESESKKEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 45872 - protein, 169 aa, Homo sapiens
  Payload ID: 9368
  Gene Symbol: LETM2
  Gene Name: leucine zipper-EF-hand containing transmembrane protein 2
  ENSP ID: ENSP00000428944
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRCF

SEQ ID NO: 45873 - protein, 122 aa, Homo sapiens
  Payload ID: 9368
  Gene Symbol: LETM2
  Gene Name: leucine zipper-EF-hand containing transmembrane protein 2
  ENSP ID: ENSP00000429019
MKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRCF

SEQ ID NO: 45874 - protein, 173 aa, Homo sapiens
  Payload ID: 9368
  Gene Symbol: LETM2
  Gene Name: leucine zipper-EF-hand containing transmembrane protein 2
  ENSP ID: ENSP00000429269
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRVGKNHI

SEQ ID NO: 45875 - protein, 443 aa, Homo sapiens
  Payload ID: 9368
  Gene Symbol: LETM2
  Gene Name: leucine zipper-EF-hand containing transmembrane protein 2
  ENSP ID: ENSP00000431211
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRREEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 45876 - protein, 116 aa, Homo sapiens
  Payload ID: 9368
  Gene Symbol: LETM2
  Gene Name: leucine zipper-EF-hand containing transmembrane protein 2
  ENSP ID: ENSP00000432080
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIK

SEQ ID NO: 45877 - protein, 86 aa, Homo sapiens
  Payload ID: 9368
  Gene Symbol: LETM2
  Gene Name: leucine zipper-EF-hand containing transmembrane protein 2
  ENSP ID: ENSP00000432607
  MOD_RES (1)..(1): Any amino acid
XENVPPSLLLLSRTFYLIDVKPKPIEIPLSGEDEDFIQPPPVTSSPITPSTPISLPKGPITSSEEPTLQAKSQMTAQNSKASSKGA

SEQ ID NO: 45878 - protein, 142 aa, Homo sapiens
  Payload ID: 9368
  Gene Symbol: LETM2
  Gene Name: leucine zipper-EF-hand containing transmembrane protein 2
  ENSP ID: ENSP00000432955
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWI

SEQ ID NO: 45879 - protein, 277 aa, Homo sapiens
  Payload ID: 9368
  Gene Symbol: LETM2
  Gene Name: leucine zipper-EF-hand containing transmembrane protein 2
  Uniprot ID: Q2VYF4
  ENSP ID: ENSP00000434867
MEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 45880 - protein, 692 aa, Homo sapiens
  Payload ID: 9369
  Gene Symbol: LEKR1
  Gene Name: leucine, glutamate and lysine rich 1
  ENSP ID: ENSP00000348936
MDHHIPMHALPEEIQKMLPEEKVCKYCGVSYLILHEFKAMEEKVKAMEKEMKFYQGSVDREKRLQEKLHSLSQELEQYKIDNKSKTERIYDVGMQLKSQQNEFQKVKKQLSHLQDELKIKYRQSYIFSQRLSEYKYFWNKTLSLLTFTKRELTSIKNEVYDNYQNWTSLKGAVFLQIKSISETALTEIDILNKSLTVSQRNKVCLEKEMKNLKLLSDAAILRSQQIRTSRQQEVNLQTRCYDLQKEVLDLQCLVEALGLKLQKAVTEMDNYKEMLMNKSNEADDCQRELKKLKFESIISESQHTMLLKEKEDSLMTCQQIYKALQEELTVKEKQEEDIKRRINLAENELEITKTLLNQTREEVLTLKNERELMLISHQKSIEQLQETLRQKLLSDDNWKEKIEAELAKERAQHLVEFEEQALLFKEETKLQLDIEKEKHQDVIQKYKKEQEELQMKISDLITGATRDLRQEVTTLKEKLHKSHIRYTEESNSKEKEIENLKNLVAEFESRLKKEIDSNDSVSENLRKEMEQKSDELKRVMLAQTQLIEQFNQSQEENTFLQETVRRECEERFELTEALSQAREQLLELSKLRGSLPFSPCSLSKGSLTSPAAAVSNHGERSLARLNSEKGIQIPNLRGVSKPTTFPTSDKPKRVRSGVPILPQPHPPRGGASSANETRQRLAAILRRRRSQQ

SEQ ID NO: 45881 - protein, 388 aa, Homo sapiens [sequence omitted]

SEQ ID NO: 45882 - protein, 123 aa, Homo sapiens
  Payload ID: 9369
  Gene Symbol: LEKR1
  Gene Name: leucine, glutamate and lysine rich 1
  ENSP ID: ENSP00000421730
MDHHIPMHALPEEIQKMLPEEKVCKYCGVSYLILHEFKAMEEKVKAMEKEMKFYQGSVDREKRLQEKLHSLSQELEQYKIDNKSKTESKIYFRLMLRLEVEHCQLKERMPDLQHSVTEPYIGL

SEQ ID NO: 45883 - protein, 132 aa, Homo sapiens
  Payload ID: 9369
  Gene Symbol: LEKR1
  Gene Name: leucine, glutamate and lysine rich 1
  ENSP ID: ENSP00000425282
MDHHIPMHALPEEIQKMLPEEKVCKYCGVSYLILHEFKAMEEKVKAMEKEMKFYQGSVDREKRLQEKLHSLSQELEQYKIDNKSKTERIYDVGMQLKSQQNEFQKVKKQLSHLQDELKIKYRQSYIFRLCFC

SEQ ID NO: 45884 - protein, 110 aa, Homo sapiens
  Payload ID: 9369
  Gene Symbol: LEKR1
  Gene Name: leucine, glutamate and lysine rich 1
  ENSP ID: ENSP00000425746
MDHHIPMHALPEEIQKMLPEEKVCKYCGVSYLILHEFKAMEEKVKAMEKEMKFYQGSVDREKRLQEKLHSLSQELEQYKIDNKSKTERLSMFFFSIIYLVERQLQEINTL

SEQ ID NO: 45885 - protein, 132 aa, Homo sapiens; identical to SEQ ID NO: 45883
  Payload ID: 9369
  Gene Symbol: LEKR1
  Gene Name: leucine, glutamate and lysine rich 1
  ENSP ID: ENSP00000474182

SEQ ID NO: 45886 - protein, 347 aa, Homo sapiens
  Payload ID: 9370
  Gene Symbol: LRG1
  Gene Name: leucine-rich alpha-2-glycoprotein 1
  Uniprot ID: P02750
  ENSP ID: ENSP00000302621
MSSWSRQRPKSPGGIQPHVSRTLFLLLLLAASAWGVTLSPKDCQVFRSDHGSSISCQPPAEIPGYLPADTVHLAVEFFNLTHLPANLLQGASKLQELHLSSNGLESLSPEFLRPVPQLRVLDLTRNALTGLPPGLFQASATLDTLVLKENQLEVLEVSWLHGLKALGHLDLSGNRLRKLPPGLLANFTLLRTLDLGENQLETLPPDLLRGPLQLERLHLEGNKLQVLGKDLLLPQPDLRYLFLNGNKLARVAAGAFQGLRQLDMLDLSNNSLASVPEGLWASLGQPNWDMRDGFDISGNPWICDQNLSDLYRWLQAQKDKMFSQNDTRCAGPEAVKGQTLLAVAKSQ

SEQ ID NO: 45887 - protein, 1394 aa, Homo sapiens
  Payload ID: 9371
  Gene Symbol: LRPPRC
  Gene Name: leucine-rich pentatricopeptide repeat containing
  Uniprot ID: P42704
  ENSP ID: ENSP00000260665
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQRCGAIAEQTPILLLFLLRNSRKQGKASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 45888 - protein, 531 aa, Homo sapiens
  Payload ID: 9371
  Gene Symbol: LRPPRC
  Gene Name: leucine-rich pentatricopeptide repeat containing
  ENSP ID: ENSP00000386234
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFYFPI

SEQ ID NO: 45889 - protein, 504 aa, Homo sapiens
  Payload ID: 9371
  Gene Symbol: LRPPRC
  Gene Name: leucine-rich pentatricopeptide repeat containing
  ENSP ID: ENSP00000386562
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQVSTSVVLI

SEQ ID NO: 45890 - protein, 359 aa, Homo sapiens
  Payload ID: 9371
  Gene Symbol: LRPPRC
  Gene Name: leucine-rich pentatricopeptide repeat containing
  ENSP ID: ENSP00000403637
MPPPICPPLAPGPWPGECPGPFSRGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNT

SEQ ID NO: 45891 - protein, 77 aa, Homo sapiens
  Payload ID: 9371
  Gene Symbol: LRPPRC
  Gene Name: leucine-rich pentatricopeptide repeat containing
  ENSP ID: ENSP00000414207
VTDFFLQLVDAGKVDDARALLQRCGAIAEQTPILLLFLLRNSRKQGKASTVKSVLELIPELNEKEEAYNSLMKSYEK

SEQ ID NO: 45892 - protein, 951 aa, Homo sapiens
  Payload ID: 9372
  Gene Symbol: LGR4
  Gene Name: leucine-rich repeat containing G protein-coupled receptor 4
  Uniprot ID: Q9BXB1
  ENSP ID: ENSP00000368516
MPGPLGLLCFLALGLLGSAGPSGAAPPLCAAPCSCDGDRRVDCSGKGLTAVPEGLSAFTQALDISMNNITQLPEDAFKNFPFLEELQLAGNDLSFIHPKALSGLKELKVLTLQNNQLKTVPSEAIRGLSALQSLRLDANHITSVPEDSFEGLVQLRHLWLDDNSLTEVPVHPLSNLPTLQALTLALNKISSIPDFAFTNLSSLVVLHLHNNKIRSLSQHCFDGLDNLETLDLNYNNLGEFPQAIKALPSLKELGFHSNSISVIPDGAFDGNPLLRTIHLYDNPLSFVGNSAFHNLSDLHSLVIRGASMVQQFPNLTGTVHLESLTLTGTKISSIPNNLCQEQKMLRTLDLSYNNIRDLPSFNGCHALEEISLQRNQIYQIKEGTFQGLISLRILDLSRNLIHEIHSRAFATLGPITNLDVSFNELTSFPTEGLNGLNQLKLVGNFKLKEALAAKDFVNLRSLSVPYAYQCCAFWGCDSYANLNTEDNSLQDHSVAQEKGTADAANVTSTLENEEHSQIIIHCTPSTGAFKPCEYLLGSWMIRLTVWFIFLVALFFNLLVILTTFASCTSLPSSKLFIGLISVSNLFMGIYTGILTFLDAVSWGRFAEFGIWWETGSGCKVAGFLAVFSSESAIFLLMLATVERSLSAKDIMKNGKSNHLKQFRVAALLAFLGATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 45893 - protein, 927 aa, Homo sapiens
  Payload ID: 9372
  Gene Symbol: LGR4
  Gene Name: leucine-rich repeat containing G protein-coupled receptor 4
  Uniprot ID: Q9BXB1
  ENSP ID: ENSP00000374508
MPGPLGLLCFLALGLLGSAGPSGAAPPLCAAPCSCDGDRRVDCSGKGLTAVPEGLSAFTQALQLAGNDLSFIHPKALSGLKELKVLTLQNNQLKTVPSEAIRGLSALQSLRLDANHITSVPEDSFEGLVQLRHLWLDDNSLTEVPVHPLSNLPTLQALTLALNKISSIPDFAFTNLSSLVVLHLHNNKIRSLSQHCFDGLDNLETLDLNYNNLGEFPQAIKALPSLKELGFHSNSISVIPDGAFDGNPLLRTIHLYDNPLSFVGNSAFHNLSDLHSLVIRGASMVQQFPNLTGTVHLESLTLTGTKISSIPNNLCQEQKMLRTLDLSYNNIRDLPSFNGCHALEEISLQRNQIYQIKEGTFQGLISLRILDLSRNLIHEIHSRAFATLGPITNLDVSFNELTSFPTEGLNGLNQLKLVGNFKLKEALAAKDFVNLRSLSVPYAYQCCAFWGCDSYANLNTEDNSLQDHSVAQEKGTADAANVTSTLENEEHSQIIIHCTPSTGAFKPCEYLLGSWMIRLTVWFIFLVALFFNLLVILTTFASCTSLPSSKLFIGLISVSNLFMGIYTGILTFLDAVSWGRFAEFGIWWETGSGCKVAGFLAVFSSESAIFLLMLATVERSLSAKDIMKNGKSNHLKQFRVAALLAFLGATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 45894 - protein, 158 aa, Homo sapiens
  Payload ID: 9372
  Gene Symbol: LGR4
  Gene Name: leucine-rich repeat containing G protein-coupled receptor 4
  ENSP ID: ENSP00000431650
MPGPLGLLCFLALGLLGSAGPSGAAPPLCAAPCSCDGDRRVDCSGKGLTAVPEGLSAFTQALDISMNNITQLPEDAFKNFPFLEELRLDANHITSVPEDSFEGLVQLRHLWLDDNSLTEVPVHPLSNLPTLQALTLALNKISSIPDFAFTNLSSLVVL

SEQ ID NO: 45895 - protein, 907 aa, Homo sapiens
  Payload ID: 9373
  Gene Symbol: LGR5
  Gene Name: leucine-rich repeat containing G protein-coupled receptor 5
  Uniprot ID: O75473
  ENSP ID: ENSP00000266674
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 45896 - protein, 883 aa, Homo sapiens
  Payload ID: 9373
  Gene Symbol: LGR5
  Gene Name: leucine-rich repeat containing G protein-coupled receptor 5
  Uniprot ID: O75473
  ENSP ID: ENSP00000441035
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 45897 - protein, 835 aa, Homo sapiens
  Payload ID: 9373
  Gene Symbol: LGR5
  Gene Name: leucine-rich repeat containing G protein-coupled receptor 5
  Uniprot ID: O75473
  ENSP ID: ENSP00000443033
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 45898 - protein, 915 aa, Homo sapiens
  Payload ID: 9374
  Gene Symbol: LGR6
  Gene Name: leucine-rich repeat containing G protein-coupled receptor 6
  Uniprot ID: Q9HBX8
  ENSP ID: ENSP00000255432
MGRPRLTLVCQVSIIISARDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 45899 - protein, 967 aa, Homo sapiens
  Payload ID: 9374
  Gene Symbol: LGR6
  Gene Name: leucine-rich repeat containing G protein-coupled receptor 6
  Uniprot ID: Q9HBX8
  ENSP ID: ENSP00000356247
MPSPPGLRALWLCAALCASRRAGGAPQPGPGPTACPAPCHCQEDGIMLSADCSELGLSAVPGDLDPLTAYLDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 45900 - protein, 828 aa, Homo sapiens
  Payload ID: 9374
  Gene Symbol: LGR6
  Gene Name: leucine-rich repeat containing G protein-coupled receptor 6
  Uniprot ID: Q9HBX8
  ENSP ID: ENSP00000387869
MRLEGEGRSARAGQNLSRAGSARRGAPRDLSMNNLTELQPGLFHHLRFLEELRLSGNHLSHIPGQAFSGLYSLKILMLQNNQLGGIPAEALWELPSLQSLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 45901 - protein, 232 aa, Homo sapiens
  Payload ID: 9374
  Gene Symbol: LGR6
  Gene Name: leucine-rich repeat containing G protein-coupled receptor 6
  ENSP ID: ENSP00000402284
MNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLDLNYNKLQEFPVAIRTLGRLQELSLNGAMDIQEFPDLKGTTSLEILTLTRAGIRLLPSGMCQQLPRLRVLELSHNQIEELPSLHRCQKLEE

SEQ ID NO: 45902 - protein, 348 aa, Homo sapiens
  Payload ID: 9374
  Gene Symbol: LGR6
  Gene Name: leucine-rich repeat containing G protein-coupled receptor 6
  ENSP ID: ENSP00000422143
MGRPRLTLVCQVSIIISARDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEMRSGGLYFLPPSARGAWSGARV

SEQ ID NO: 45903 - protein, 2015 aa, Homo sapiens
  Payload ID: 9375
  Gene Symbol: LRRK1
  Gene Name: leucine-rich repeat kinase 1
  Uniprot ID: Q38SD2
  ENSP ID: ENSP00000373600
MAGMSQRPPSMYWCVGPEESAVCPERAMETLNGAGDTGGKPSTRGGDPAARSRRTEGIRAAYRRGDRGGARDLLEEACDQCASQLEKGQLLSIPAAYGDLEMVRYLLSKRLVELPTEPTDDNPAVVAAYFGHTAVVQELLESLPGPCSPQRLLNWMLALACQRGHLGVVKLLVLTHGADPESYAVRKNEFPVIVRLPLYAAIKSGNEDIAIFLLRHGAYFCSYILLDSPDPSKHLLRKYFIEASPLPSSYPGKTALRVKWSHLRLPWVDLDWLIDISCQITELDLSANCLATLPSVIPWGLINLRKLNLSDNHLGELPGVQSSDEIICSRLLEIDISSNKLSHLPPGFLHLSKLQKLTASKNCLEKLFEEENATNWIGLRKLQELDISDNKLTELPALFLHSFKSLNSLNVSRNNLKVFPDPWACPLKCCKASRNALECLPDKMAVFWKNHLKDVDFSENALKEVPLGLFQLDALMFLRLQGNQLAALPPQEKWTCRQLKTLDLSRNQLGKNEDGLKTKRIAFFTTRGRQRSGTEAASVLEFPAFLSESLEVLCLNDNHLDTVPPSVCLLKSLSELYLGNNPGLRELPPELGQLGNLWQLDTEDLTISNVPAEIQKEGPKAMLSYLRAQLRKAEKCKLMKMIIVGPPRQGKSTLLEILQTGRAPQVVHGEATIRTTKWELQRPAGSRAKVESVEFNVWDIGGPASMATVNQCFFTDKALYVVVWNLALGEEAVANLQFWLLNIEAKAPNAVVLVVGTHLDLIEAKFRVERIATLRAYVLALCRSPSGSRATGFPDITFKHLHEISCKSLEGQEGLRQLIFHVTCSMKDVGSTIGCQRLAGRLIPRSYLSLQEAVLAEQQRRSRDDDVQYLTDRQLEQLVEQTPDNDIKDYEDLQSAISFLIETGTLLHFPDTSHGLRNLYFLDPIWLSECLQRIFNIKGSRSVAKNGVIRAEDLRMLLVGTGFTQQTEEQYFQFLAKFEIALPVANDSYLLPHLLPSKPGLDTHGMRHPTANTIQRVFKMSFVPVGFWQRFIARMLISLAEMDLQLFENKKNTKSRNRKVTIYSFTGNQRNRCSTFRVKRNQTIYWQEGLLVTFDGGYLSVESSDVNWKKKKSGGMKIVCQSEVRDFSAMAFITDHVNSLIDQWFPALTATESDGTPLMEQYVPCPVCETAWAQHTDPSEKSEDVQYFDMEDCVLTAIERDFISCPRHPDLPVPLQELVPELFMTDFPARLFLENSKLEHSEDEGSVLGQGGSGTVIYRARYQGQPVAVKRFHIKKFKNFANVPADTMLRHLRATDAMKNFSEFRQEASMLHALQHPCIVALIGISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSGAQRGRVIAVLKARELTPHGVLVDAAVVAKDTVVCTFENENTEWCLAVWRGWGAREFDIFYQSYEELGRLEACTRKRR

SEQ ID NO: 45904 - protein, 650 aa, Homo sapiens
  Payload ID: 9375
  Gene Symbol: LRRK1
  Gene Name: leucine-rich repeat kinase 1
  ENSP ID: ENSP00000431668
MAGMSQRPPSMYWCVGPEESAVCPERAMETLNGAGDTGGKPSTRGGDPAARSRRTEGIRAAYRRGDRGGARDLLEEACDQCASQLEKGQLLSIPAAYGDLEMVRYLLSKRLVELPTEPTDDNPAVVAAYFGHTAVVQELLESLPGPCSPQRLLNWMLALACQRGHLGVVKLLVLTHGADPESYAVRKNEFPVIVRLPLYAAIKSGNEDIAIFLLRHGAYFCSYILLDSPDPSKHLLRKYFIEASPLPSSYPGKTALRVKWSHLRLPWVDLDWLIDISCQITELDLSANCLATLPSVIPWGLINLRKLNLSDNHLGELPGVQSSDEIICSRLLEIDISSNKLSHLPPGFLHLSKLQKLTASKNCLEKLFEEENATNWIGLRKLQELDISDNKLTELPALFLHSFKSLNSLNVSRNNLKVFPDPWACPLKCCKASRNALECLPDKMAVFWKNHLKDVDFSENALKEVPLGLFQLDALMFLRLQGNQLAALPPQEKWTCRQLKTLDLSRNQLGKNEDGLKTKRIAFFTTRGRQRSGTEAASVLEFPAFLSESLEVLCLNDNHLDTVPPSVCLLKSLSELYLGNNPGLRELPPELGQLGNLWQLDTEDLTISNVPAEIQKEGPKAMLSYLRAQLRKAEKCKLMKMIIVGPPRQG

SEQ ID NO: 45905 - protein, 689 aa, Homo sapiens
  Payload ID: 9375
  Gene Symbol: LRRK1
  Gene Name: leucine-rich repeat kinase 1
  ENSP ID: ENSP00000433069
MAGMSQRPPSMYWCVGPEESAVCPERAMETLNGAGDTGGKPSTRGGDPAARSRRTEGIRAAYRRGDRGGARDLLEEACDQCASQLEKGQLLSIPAAYGDLEMVRYLLSKRLVELPTEPTDDNPAVVAAYFGHTAVVQELLESLPGPCSPQRLLNWMLALACQRGHLGVVKLLVLTHGADPESYAVRKNEFPVIVRLPLYAAIKSGNEDIAIFLLRHGAYFCSYILLDSPDPSKHLLRKYFIEASPLPSSYPGKTALRVKWSHLRLPWVDLDWLIDISCQITELDLSANCLATLPSVIPWGLINLRKLNLSDNHLGELPGVQSSDEIICSRLLEIDISSNKLSHLPPGFLHLSKLQKLTASKNCLEKLFEEENATNWIGLRKLQELDISDNKLTELPALFLHSFKSLNSLNVSRNNLKVFPDPWACPLKCCKASRNALECLPDKMAVFWKNHLKDVDFSENALKEVPLGLFQLDALMFLRLQGNQLAALPPQEKWTCRQLKTLDLSRNQLGKNEDGLKTKRIAFFTTRGRQRSGTEAASVLEFPAFLSESLEVLCLNDNHLDTVPPSVCLLKSLSELYLGNNPGLRELPPELGQLGNLWQLDTEDLTISNVPAEIQKEGPKAMLSYLRAQLRKAEKCKLMKMIIVGPPRQGKSTLLEILQTGRAPQVVHGEATIRTTKWELQRPAGSRAK

SEQ ID NO: 45906 - protein, 264 aa, Homo sapiens
  Payload ID: 9375
  Gene Symbol: LRRK1
  Gene Name: leucine-rich repeat kinase 1
  Uniprot ID: Q38SD2
  ENSP ID: ENSP00000433268
MAGMSQRPPSMYWCVGPEESAVCPERAMETLNGAGDTGGKPSTRGGDPAARSRRTEGIRAAYRRGDRGGARDLLEEACDQCASQLEKGQLLSIPAAYGDLEMVRYLLSKRLVELPTEPTDDNPAVVAAYFGHTAVVQELLESLPGPCSPQRLLNWMLALACQRGHLGVVKLLVLTHGADPESYAVRKNEFPVIVRLPLYAAIKSGNEDIAIFLLRHGAYFCSYILLDSPDPSKHLLRKYFIEASPLPSSYPGKTVSSHCLWSVF

SEQ ID NO: 45907 - protein, 32 aa, Homo sapiens
  Payload ID: 9375
  Gene Symbol: LRRK1
  Gene Name: leucine-rich repeat kinase 1
  ENSP ID: ENSP00000435148
MAGMSQRPPSMYWCVGPEESAVCPERAMETLN

SEQ ID NO: 45908 - protein, 660 aa, Homo sapiens
  Payload ID: 9375
  Gene Symbol: LRRK1
  Gene Name: leucine-rich repeat kinase 1
  ENSP ID: ENSP00000436672
  MOD_RES (1)..(1): Any amino acid
XISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSGAQRGRVIAVLKARELTPHGIMPVSSVKVCWAGWPVRDMVYMVAVM

SEQ ID NO: 45909 - protein, 2527 aa, Homo sapiens
  Payload ID: 9376
  Gene Symbol: LRRK2
  Gene Name: leucine-rich repeat kinase 2
  Uniprot ID: Q5S007
  ENSP ID: ENSP00000298910
MASGSCQGCEEDEETLKKLIVRLNNVQEGKQIETLVQILEDLLVFTYSERASKLFQGKNIHVPLLIVLDSYMRVASVQQVGWSLLCKLIEVCPGTMQSLMGPQDVGNDWEVLGVHQLILKMLTVHNASVNLSVIGLKTLDLLLTSGKITLLILDEESDIFMLIFDAMHSFPANDEVQKLGCKALHVLFERVSEEQLTEFVENKDYMILLSALTNFKDEEEIVLHVLHCLHSLAIPCNNVEVLMSGNVRCYNIVVEAMKAFPMSERIQEVSCCLLHRLTLGNFFNILVLNEVHEFVVKAVQQYPENAALQISALSCLALLTETIFLNQDLEEKNENQENDDEGEEDKLFWLEACYKALTWHRKNKHVQEAACWALNNLLMYQNSLHEKIGDEDGHFPAHREVMLSMLMHSSSKEVFQASANALSTLLEQNVNFRKILLSKGIHLNVLELMQKHIHSPEVAESGCKMLNHLFEGSNTSLDIMAAVVPKILTVMKRHETSLPVQLEALRAILHFIVPGMPEESREDTEFHHKLNMVKKQCFKNDIHKLVLAALNRFIGNPGIQKCGLKVISSIVHFPDALEMLSLEGAMDSVLHTLQMYPDDQEIQCLGLSLIGYLITKKNVFIGTGHLLAKILVSSLYRFKDVAEIQTKGFQTILAILKLSASFSKLLVHHSFDLVIFHQMSSNIMEQKDQQFLNLCCKCFAKVAMDDYLKNVMLERACDQNNSIMVECLLLLGADANQAKEGSSLICQVCEKESSPKLVELLLNSGSREQDVRKALTISIGKGDSQIISLLLRRLALDVANNSICLGGFCIGKVEPSWLGPLFPDKTSNLRKQTNIASTLARMVIRYQMKSAVEEGTASGSDGNFSEDVLSKFDEWTFIPDSSMDSVFAQSDDLDSEGSEGSFLVKKKSNSISVGEFYRDAVLQRCSPNLQRHSNSLGPIFDHEDLLKRKRKILSSDDSLRSSKLQSHMRHSDSISSLASEREYITSLDLSANELRDIDALSQKCCISVHLEHLEKLELHQNALTSFPQQLCETLKSLTHLDLHSNKFTSFPSYLLKMSCIANLDVSRNDIGPSVVLDPTVKCPTLKQFNLSYNQLSFVPENLTDVVEKLEQLILEGNKISGICSPLRLKELKILNLSKNHISSLSENFLEACPKVESFSARMNFLAAMPFLPPSMTILKLSQNKFSCIPEAILNLPHLRSLDMSSNDIQYLPGPAHWKSLNLRELLFSHNQISILDLSEKAYLWSRVEKLHLSHNKLKEIPPEIGCLENLTSLDVSYNLELRSFPNEMGKLSKIWDLPLDELHLNFDFKHIGCKAKDIIRFLQQRLKKAVPYNRMKLMIVGNTGSGKTTLLQQLMKTKKSDLGMQSATVGIDVKDWPIQIRDKRKRDLVLNVWDFAGREEFYSTHPHFMTQRALYLAVYDLSKGQAEVDAMKPWLFNIKARASSSPVILVGTHLDVSDEKQRKACMSKITKELLNKRGFPAIRDYHFVNATEESDALAKLRKTIINESLNFKIRDQLVVGQLIPDCYVELEKIILSERKNVPIEFPVIDRKRLLQLVRENQLQLDENELPHAVHFLNESGVLLHFQDPALQLSDLYFVEPKWLCKIMAQILTVKVEGCPKHPKGIISRRDVEKFLSKKRKFPKNYMSQYFKLLEKFQIALPIGEEYLLVPSSLSDHRPVIELPHCENSEIIIRLYEMPYFPMGFWSRLINRLLEISPYMLSGRERALRPNRMYWRQGIYLNWSPEAYCLVGSEVLDNHPESFLKITVPSCRKGCILLGQVVDHIDSLMEEWFPGLLEIDICGEGETLLKKWALYSFNDGEEHQKILLDDLMKKAEEGDLLVNPDQPRLTIPISQIAPDLILADLPRNIMLNNDELEFEQAPEFLLGDGSFGSVYRAAYEGEEVAVKIFNKHTSLRLLRQELVVLCHLHHPSLISLLAAGIRPRMLVMELASKGSLDRLLQQDKASLTRTLQHRIALHVADGLRYLHSAMIIYRDLKPHNVLLFTLYPNAAIIAKIADYGIAQYCCRMGIKTSEGTPGFRAPEVARGNVIYNQQADVYSFGLLLYDILTTGGRIVEGLKFPNEFDELEIQGKLPDPVKEYGCAPWPMVEKLIKQCLKENPQERPTSAQVFDILNSAELVCLTRRILLPKNVIVECMVATHHNSRNASIWLGCGHTDRGQLSFLDLNTEGYTSEEVADSRILCLALVHLPVEKESWIVSGTQSGTLLVINTEDGKKRHTLEKMTDSVTCLYCNSFSKQSKQKNFLLVGTADGKLAIFEDKTVKLKGAAPLKILNIGNVSTPLMCLSESTNSTERNVMWGGCGTKIFSFSNDFTIQKLIETRTSQLFSYAAFSDSNIITVVVDTALYIAKQNSPVVEVWDKKTEKLCGLIDCVHFLREVMVKENKESKHKMSYSGRVKTLCLQKNTALWIGTGGGHILLLDLSTRRLIRVIYNFCNSVRVMMTAQLGSLKNVMLVLGYNRKNTEGTQKQKEIQSCLTVWDINLPHEVQNLEKHIEVRKELAEKMRRTSVE

SEQ ID NO: 45910 - protein, 1271 aa, Homo sapiens
  Payload ID: 9376
  Gene Symbol: LRRK2
  Gene Name: leucine-rich repeat kinase 2
  ENSP ID: ENSP00000341930
MASGSCQGCEEDEETLKKLIVRLNNVQEGKQIETLVQILEDLLVFTYSERASKLFQGKNIHVPLLIVLDSYMRVASVQQVGWSLLCKLIEVCPGTMQSLMGPQDVGNDWEVLGVHQLILKMLTVHNASVNLSVIGLKTLDLLLTSGKITLLILDEESDIFMLIFDAMHSFPANDEVQKLGCKALHVLFERVSEEQLTEFVENKDYMILLSALTNFKDEEEIVLHVLHCLHSLAIPCNNVEVLMSGNVRCYNIVVEAMKAFPMSERIQEVSCCLLHRLTLGNFFNILVLNEVHEFVVKAVQQYPENAALQISALSCLALLTETIFLNQDLEEKNENQENDDEGEEDKLFWLEACYKALTWHRKNKHVQEAACWALNNLLMYQNSLHEKIGDEDGHFPAHREVMLSMLMHSSSKEVFQASANALSTLLEQNVNFRKILLSKGIHLNVLELMQKHIHSPEVAESGCKMLNHLFEGSNTSLDIMAAVVPKILTVMKRHETSLPVQLEALRAILHFIVPGMPEESREDTEFHHKLNMVKKQCFKNDIHKLVLAALNRFIGNPGIQKCGLKVISSIVHFPDALEMLSLEGAMDSVLHTLQMYPDDQEIQCLGLSLIGYLITKKNVFIGTGHLLAKILVSSLYRFKDVAEIQTKGFQTILAILKLSASFSKLLVHHSFDLVIFHQMSSNIMEQKDQQFLNLCCKCFAKVAMDDYLKNVMLERACDQNNSIMVECLLLLGADANQAKEGSSLICQVCEKESSPKLVELLLNSGSREQDVRKALTISIGKGDSQIISLLLRRLALDVANNSICLGGFCIGKVEPSWLGPLFPDKTSNLRKQTNIASTLARMVIRYQMKSAVEEGTASGSDGNFSEDVLSKFDEWTFIPDSSMDSVFAQSDDLDSEGSEGSFLVKKKSNSISVGEFYRDAVLQRCSPNLQRHSNSLGPIFDHEDLLKRKRKILSSDDSLRSSKLQSHMRHSDSISSLASEREYITSLDLSANELRDIDALSQKCCISVHLEHLEKLELHQNALTSFPQQLCETLKSLTHLDLHSNKFTSFPSYLLKMSCIANLDVSRNDIGPSVVLDPTVKCPTLKQFNLSYNQLSFVPENLTDVVEKLEQLILEGNKISGICSPLRLKELKILNLSKNHISSLSENFLEACPKVESFSARMNFLAAMPFLPPSMTILKLSQNKFSCIPEAILNLPHLRSLDMSSNDIQYLPGPAHWKSLNLRELLFSHNQISILDLSEKAYLWSRVEKLHLSHNKLKEVRRLLPLKKYTL

SEQ ID NO: 45911 - protein, 521 aa, Homo sapiens
  Payload ID: 9376
  Gene Symbol: LRRK2
  Gene Name: leucine-rich repeat kinase 2
  ENSP ID: ENSP00000398726
MRVASVQQVGWSLLCKLIEVCPGTMQSLMGPQDVGNDWEVLGVHQLILKMLTVHNASVNLSVIGLKTLDLLLTSGKITLLILDEESDIFMLIFDAMHSFPANDEVQKLGCKALHVLFERGNNVEVLMSGNVRCYNIVVEAMKAFPMSERIQEVSCCLLHRLTLGNFFNILVLNEVHEFVVKAVQQYPENAALQISALSCLALLRSFPGICECIVNSLRTKCNTSLDIMAAVVPKILTVMKRHETSLPVQLEALRAILHFIVPGMPEESREDTEFHHKLNMVKKQCFKNDIHKLVLAALNRFIGNPGIQKCGLKVISSIVHFPDALEMLSLEGAMDSVLHTLQMYPDDQEIQCLGLSLIGYLITKKNVFIGTGHLLAKILVSSLYRFKDVAEIQTKGFQTILAILKLSASFSKLLVHHSFDLVIFHQMSSNIMEQKDQQFLNLCCKCFAKVAMDDYLKNVMLERACDQNNSIMVECLLLLGADANQAKEGSSLICQVCEKESSPKLVELLLNSGSREQDVRK

SEQ ID NO: 45912 - protein, 207 aa, Homo sapiens
  Payload ID: 9376
  Gene Symbol: LRRK2
  Gene Name: leucine-rich repeat kinase 2
  ENSP ID: ENSP00000410821
  MOD_RES (1)..(1): Any amino acid
XLDLSANELRDIDALSQKCCISVHLEHLEKLELHQNALTSFPQQLCETLKSLTHLDLHSNKFTSFPSYLLKMSCIANLDVSRNDIGPSVVLDPTVKCPTLKQFNLSYNQLSFVPENLTDVVEKLEQLILEGNKISGICSPLRLKELKILNLSKNHISSLSENFLEACPKVESFSARMNFLVSGCSVVPQGNLIQTVESGKHFCACDI

SEQ ID NO: 45913 - protein, 545 aa, Homo sapiens
  Payload ID: 9377
  Gene Symbol: LGI2
  Gene Name: leucine-rich repeat LGI family, member 2
  Uniprot ID: Q8N0V4
  ENSP ID: ENSP00000371548
MALRRGGCGALGLLLLLLGAACLIPRSAQVRRLARCPATCSCTKESIICVGSSWVPRIVPGDISSLSLVNGTFSEIKDRMFSHLPSLQLLLLNSNSFTIIRDDAFAGLFHLEYLFIEGNKIETISRNAFRGLRDLTHLSLANNHIKALPRDVFSDLDSLIELDLRGNKFECDCKAKWLYLWLKMTNSTVSDVLCIGPPEYQEKKLNDVTSFDYECTTTDFVVHQTLPYQSVSVDTFNSKNDVYVAIAQPSMENCMVLEWDHIEMNFRSYDNITGQSIVGCKAILIDDQVFVVVAQLFGGSHIYKYDESWTKFVKFQDIEVSRISKPNDIELFQIDDETFFVIADSSKAGLSTVYKWNSKGFYSYQSLHEWFRDTDAEFVDIDGKSHLILSSRSQVPIILQWNKSSKKFVPHGDIPNMEDVLAVKSFRMQNTLYLSLTRFIGDSRVMRWNSKQFVEIQALPSRGAMTLQPFSFKDNHYLALGSDYTFSQIYQWDKEKQLFKKFKEIYVQAPRSFTAVSTDRRDFFFASSFKGKTKIFEHIIVDLSL

SEQ ID NO: 45914 - protein, 256 aa, Homo sapiens
  Payload ID: 9377
  Gene Symbol: LGI2
  Gene Name: leucine-rich repeat LGI family, member 2
  ENSP ID: ENSP00000426254
  MOD_RES (1)..(1): Any amino acid
XLGLLLLLLGAACLIPRSAQVRRLARCPATCSCTKESIICVGSSWVPRIVPGDISSLSLVNGTFSEIKDRMFSHLPSLQLLLLNSNSFTIIRDDAFAGLFHLEYLFIEGNKIETISRNAFRGLRDLTHLSLANNHIKALPRDVFSDLDSLIELDLRGNKFECDCKAKWLYLWLKMTNSTVSDVLCIGPPEYQEKKLNDVTSFDYECTTTDKQEEICEGKIQNLNARVVMNCSRPSSAFRKHTGNGRVAFFLPHGVR

SEQ ID NO: 45915 - protein, 548 aa, Homo sapiens
  Payload ID: 9378
  Gene Symbol: LGI3
  Gene Name: leucine-rich repeat LGI family, member 3
  Uniprot ID: Q8N145
  ENSP ID: ENSP00000302297
MAGLRARGGPGPGLLALSALGFCLMLQVSAKRPPKTPPCPPSCSCTRDTAFCVDSKAVPRNLPSEVISLTLVNAAFSEIQDGAFSHLPLLQFLLLNSNKFTLIGDNAFTGLSHLQYLFIENNDIWALSKFTFRGLKSLTHLSLANNNLQTLPRDIFRPLDILNDLDLRGNSLNCDCKVKWLVEWLAHTNTTVAPIYCASPPRFQEHKVQDLPLREFDCITTDFVLYQTLAFPAVSAEPFLYSSDLYLALAQPGVSACTILKWDYVERQLRDYDRIPAPSAVHCKPMVVDSQLYVVVAQLFGGSYIYHWDPNTTRFTRLQDIDPQRVRKPNDLEAFRIDGDWYFAVADSSKAGATSLYRWHQNGFYSHQALHPWHRDTDLEFVDGEGKPRLIVSSSSQAPVIYQWSRTQKQFVAQGEVTQVPDAQAVKHFRAGRDSYLCLSRYIGDSKILRWEGTRFSEVQALPSRGSLALQPFLVGGRRYLALGSDFSFTQIYQWDEGRQKFVRFQELAVQAPRAFCYMPAGDAQLLLAPSFKGQTLVYRHIVVDLSA

SEQ ID NO: 45916 - protein, 524 aa, Homo sapiens
  Payload ID: 9378
  Gene Symbol: LGI3
  Gene Name: leucine-rich repeat LGI family, member 3
  Uniprot ID: Q8N145
  ENSP ID: ENSP00000399121
MAGLRARGGPGPGLLALSALGFCLMLQVSAKRPPKTPPCPPSCSCTRDTAFCVDSKAVPRNLPSEVISLTLVNAAFSEIQDGAFSHLPLLQFLLLNSNKFTLIGDNAFTGLSHLQYLSLANNNLQTLPRDIFRPLDILNDLDLRGNSLNCDCKVKWLVEWLAHTNTTVAPIYCASPPRFQEHKVQDLPLREFDCITTDFVLYQTLAFPAVSAEPFLYSSDLYLALAQPGVSACTILKWDYVERQLRDYDRIPAPSAVHCKPMVVDSQLYVVVAQLFGGSYIYHWDPNTTRFTRLQDIDPQRVRKPNDLEAFRIDGDWYFAVADSSKAGATSLYRWHQNGFYSHQALHPWHRDTDLEFVDGEGKPRLIVSSSSQAPVIYQWSRTQKQFVAQGEVTQVPDAQAVKHFRAGRDSYLCLSRYIGDSKILRWEGTRFSEVQALPSRGSLALQPFLVGGRRYLALGSDFSFTQIYQWDEGRQKFVRFQELAVQAPRAFCYMPAGDAQLLLAPSFKGQTLVYRHIVVDLSA

SEQ ID NO: 45917 - protein, 198 aa, Homo sapiens
  Payload ID: 9378
  Gene Symbol: LGI3
  Gene Name: leucine-rich repeat LGI family, member 3
  ENSP ID: ENSP00000427817
MCPCRDRTLVNAAFSEIQDGAFSHLPLLQFLLLNSNKFTLIGDNAFTGLSHLQYLFIENNDIWALSKFTFRGLKSLTHLSLANNNLQTLPRDIFRPLDILNDLDLRGNSLNCDCKVKWLVEWLAHTNTTVAPIYCASPPRFQEHKVQDLPLREFDCITTDFVLYQTLAFPAVSAEPFLYSSDLYLALAQPGVSACTIL

SEQ ID NO: 45918 - protein, 134 aa, Homo sapiens
  Payload ID: 9378
  Gene Symbol: LGI3
  Gene Name: leucine-rich repeat LGI family, member 3
  ENSP ID: ENSP00000430653
MAGLRARGGPGPGLLALSALGFCLMLQVSAKRPPKTPPCPPSCSCTRDTAFCVDSKAVPRNLPSEVISLTALADPTVLTRVSPQDPGECRLLRDPGWSVLPPPAAAVLVTQLQQVYTDWRQRLHRTVAPAVSLH

SEQ ID NO: 45919 - protein, 537 aa, Homo sapiens
  Payload ID: 9379
  Gene Symbol: LGI4
  Gene Name: leucine-rich repeat LGI family, member 4
  Uniprot ID: Q8N135
  ENSP ID: ENSP00000312273
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAASVVSCKPLVLGPSLFVLAARLWGGSQLWARPSPGLRLAPTQTLAPRRLLRPNDAELLWLEGQPCFVVADASKAGSTTLLCRDGPGFYPHQSLHAWHRDTDAEALELDGRPHLLLASASQRPVLFHWTGGRFERRTDIPEAEDVYATRHFQAGGDVFLCLTRYIGDSMVMRWDGSMFRLLQQLPSRGAHVFQPLLIARDQLAILGSDFAFSQVLRLEPDKGLLEPLQELGPPALVAPRAFAHITMAGRRFLFAACFKGPTQIYQHHEIDLSA

SEQ ID NO: 45920 - protein, 494 aa, Homo sapiens
  Payload ID: 9379
  Gene Symbol: LGI4
  Gene Name: leucine-rich repeat LGI family, member 4
  ENSP ID: ENSP00000376059
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPGEPPPRPSACPAACLAGLTCLPTSPQRPPWCPASHWCWARASSCWLPACGGAHSCGPGPVPACAWPQRRPWPRGGCCGPMTPSSCGWKGNPASWWPMPPRRAAPRCCAATGPAFTRTRACTPGTGTRTLRPWSWTAGPTCCWPRLPSGPCSSTGPVAASRDAQTSPRPRMSMPHATSRLVGTCSCASHATLGTPWSCAGTAPCFVCCSNFPRAVPTSSSHCSSPGTSWPS

SEQ ID NO: 45921 - protein, 378 aa, Homo sapiens
  Payload ID: 9379
  Gene Symbol: LGI4
  Gene Name: leucine-rich repeat LGI family, member 4
  ENSP ID: ENSP00000467044
  MOD_RES (1)..(1): Any amino acid
XVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAASVVSCKPLVLGPSLFVLAARLWGGSQLWARPSPGLRLAPTQTLAPRRLLRPNDAELLWLEGQPCFVVADASKAGSTTLLCRDGPGFYPHQSLHAWHRDTDAEALELDGRPHLLLASASQRPVLFHWTGGRFERRTDIPEAEDVYATRHFQAGGDVFLCLTRYIGDSMVRLGLGAGGWLFSTDPILHTKPLNSDLPSHADL

SEQ ID NO: 45922 - protein, 261 aa, Homo sapiens
  Payload ID: 9379
  Gene Symbol: LGI4
  Gene Name: leucine-rich repeat LGI family, member 4
  Uniprot ID: Q8N135
  ENSP ID: ENSP00000467784
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIGGGLSRWGGRREIWGKGCQGQEARLTPCPAISRSGKTLSKQHCLPEPQFSHL

SEQ ID NO: 45923 - protein, 623 aa, Homo sapiens
  Payload ID: 9380
  Gene Symbol: LRIT1
  Gene Name: leucine-rich repeat, immunoglobulin-like and transmembrane domains 1
  Uniprot ID: Q9P2V4
  ENSP ID: ENSP00000361177
MRVALGMLWLLALAWPPQARGFCPSQCSCSLHIMGDGSKARTVVCNDPDMTLPPASIPPDTSRLRLERTAIRRVPGEAFRPLGRLEQLWLPYNALSELNALMLRGLRRLRELRLPGNRLAAFPWAALRDAPKLRLLDLQANRLSAVPAEAARFLENLTFLDLSSNQLMRLPQELIVSWAHLETGIFPPGHHPRRVLGLQDNPWACDCRLYDLVHLLDGWAPNLAFIETELRCASPRSLAGVAFSQLELRKCQGPELHPGVASIRSLLGGTALLRCGATGVPGPEMSWRRANGRPLNGTVHQEVSSDGTSWTLLGLPAVSHLDSGDYICQAKNFLGASETVISLIVTEPPTSTEHSGSPGALWARTGGGGEAAAYNNKLVARHVPQIPKPAVLATGPSVPSTKEELTLEHFQMDALGELSDGRAGPSEARMVRSVKVVGDTYHSVSLVWKAPQAKNTTAFSVLYAVFGQHSMRRVIVQPGKTRVTITGLLPKTKYVACVCVQGLVPRKEQCVIFSTNEVVDAENTQQLINVVVISVAIVIALPLTLLVCCSALQKRCRKCFNKDSTEATVTYVNLERLGYSEDGLEELSRHSVSEADRLLSARSSVDFQAFGVKGGRRINEYFC

SEQ ID NO: 45924 - protein, 550 aa, Homo sapiens
  Payload ID: 9381
  Gene Symbol: LRIT2
  Gene Name: leucine-rich repeat, immunoglobulin-like and transmembrane domains 2
  Uniprot ID: A6NDA9
  ENSP ID: ENSP00000361185
MASVFHYFLLVLVFLDTHAAQPFCLPGCTCSEESFGRTLQCTSVSLGKIPGNLSEEFKQVRIENSPLFEMPQGSFINMSTLEYLWLNFNNISVIHLGALEHLPELRELRLEGNKLCSVPWTAFRATPLLRVLDLKRNKIDALPELALQFLVSLTYLDLSSNRLTVVSKSVFLNWPAYQKCRQPDCGAEILSSLVVALHDNPWVCDCRLRGLVQFVKSITLPVILVNSYLICQGPLSKAGQLFHETELSACMKPQISTPSANITIRAGQNVTLRCLAQASPSPSIAWTYPLSMWREFDVLTSSTGEDTALSELAIPAAHLVDSGNYTCMASNSIGKSNLVISLHVQPAQALHAPDSLSIPSEGNAYIDLRVVKQTVHGILLEWLAVADTSKEEWFTLYIASDEAFRKEVVHIGPGINTYAVDDLLPGTKYEACLSLEGQPPHQGQCVAFVTGRDAGGLEAREHLLHVTVVLCVVLLAVPVGAYAWAAQGPCSCSKWVLRGCLHRRKAPSCTPAAPQSKDGSFREHPAVCDDGEGHIDTEGDKEKGGTEDNS

SEQ ID NO: 45925 - protein, 560 aa, Homo sapiens
  Payload ID: 9381
  Gene Symbol: LRIT2
  Gene Name: leucine-rich repeat, immunoglobulin-like and transmembrane domains 2
  Uniprot ID: A6NDA9
  ENSP ID: ENSP00000438264
MASVFHYFLLVLVFLDTHAAQPFCLPGCTCSEESFGRTLQCTSVSLGKIPGNLSEEFKQVRIENSPLFEMPQGSFINMSTLEYLWLNFNNISVIHLGALEHLPELRELRLEGNKLCSVPWTAFRATPLLRVLDLKRNKIDALPELALQFLVSLTYLDLSSNRLTVVSKSVFLNWPAYQKCRQPDCGAEILSSLVVALHDNPWVCDCRLRGLVQFVKSITLPVILVNSYLICQGPLSKAGQLFHETELSACMKPQISTPSANITIRAGQNVTLRCLAQASPSPSIAWTYPLSMWREFDGLLGGKHLTPVLTSSTGEDTALSELAIPAAHLVDSGNYTCMASNSIGKSNLVISLHVQPAQALHAPDSLSIPSEGNAYIDLRVVKQTVHGILLEWLAVADTSKEEWFTLYIASDEAFRKEVVHIGPGINTYAVDDLLPGTKYEACLSLEGQPPHQGQCVAFVTGRDAGGLEAREHLLHVTVVLCVVLLAVPVGAYAWAAQGPCSCSKWVLRGCLHRRKAPSCTPAAPQSKDGSFREHPAVCDDGEGHIDTEGDKEKGGTEDNS

SEQ ID NO: 45926 - protein, 496 aa, Homo sapiens
  Payload ID: 9382
  Gene Symbol: LRIT3
  Gene Name: leucine-rich repeat, immunoglobulin-like and transmembrane domains 3
  ENSP ID: ENSP00000328222
MVEPHQEPRHSKVGLQDNPWFCDCHISKMIELSKVVDPAIVLLDPLMTCSEPERLTGILFQRAELEHCLKPSVMTSATKIMSALGSNVLLRCDATGFPTPQITWTRSDSSPVNYTVIQESPEEGVRWSIMSLTGISSKDAGDYKCKAKNLAGMSEAVVTVTVLGITTTPIPPDTSERTGDHPEWDVQPGSGRSTSVSSASSYLWSSSFSPTSSFSASTLSPPSTASFSLSPFSSSTVSSTTTLSTSISASTTMANKRSFQLHQGGKRNLKVAKNGSKLPPASTSKKEELALLDQTMLTETNAAIENLRVVSETKESVTLTWNMINTTHNSAVTVLYSKYGGKDLLLLNADSSKNQVTIDGLEPGGQYMACVCPKGVPPQKDQCITFSTERVEGDDSQWSLLLVVTSTACVVILPLICFLLYKVCKLQCKSEPFWEDDLAKETYIQFETLFPRSQSVGELWTRSHRDDSEKLLLCSRSSVESQVTFKSEGSRPEYYC

SEQ ID NO: 45927 - protein, 679 aa, Homo sapiens
  Payload ID: 9382
  Gene Symbol: LRIT3
  Gene Name: leucine-rich repeat, immunoglobulin-like and transmembrane domains 3
  Uniprot ID: Q3SXY7
  ENSP ID: ENSP00000469759
MHLFACLCIVLSFLEGVGCLCPSQCTCDYHGRNDGSGSRLVLCNDMDMNELPTNLPVDTVKLRIEKTVIRRISAEAFYYLVELQYLWVTYNSVASIDPSSFYNLKQLHELRLDGNSLAAFPWASLLDMPLLRTLDLHNNKITSVPNEALRYLKNLAYLDLSSNRLTTLPPDFLESWTHLVSTPSGVLDLSPSRIILGLQDNPWFCDCHISKMIELSKVVDPAIVLLDPLMTCSEPERLTGILFQRAELEHCLKPSVMTSATKIMSALGSNVLLRCDATGFPTPQITWTRSDSSPVNYTVIQESPEEGVRWSIMSLTGISSKDAGDYKCKAKNLAGMSEAVVTVTVLGITTTPIPPDTSERTGDHPEWDVQPGSGRSTSVSSASSYLWSSSFSPTSSFSASTLSPPSTASFSLSPFSSSTVSSTTTLSTSISASTTMANKRSFQLHQGGKRNLKVAKNGSKLPPASTSKKEELALLDQTMLTETNAAIENLRVVSETKESVTLTWNMINTTHNSAVTVLYSKYGGKDLLLLNADSSKNQVTIDGLEPGGQYMACVCPKGVPPQKDQCITFSTERVEGDDSQWSLLLVVTSTACVVILPLICFLLYKVCKLQCKSEPFWEDDLAKETYIQFETLFPRSQSVGELWTRSHRDDSEKLLLCSRSSVESQVTFKSEGSRPEYYC

SEQ ID NO: 45928 - protein, 696 aa, Homo sapiens
  Payload ID: 9383
  Gene Symbol: LRCH1
  Gene Name: leucine-rich repeats and calponin homology (CH) domain containing 1
  Uniprot ID: Q9Y2L9
  ENSP ID: ENSP00000308493
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLSLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEEKLCLPHHILEEKGLVKVGITIQALLDITVTKALFT

SEQ ID NO: 45929 - protein, 763 aa, Homo sapiens
  Payload ID: 9383
  Gene Symbol: LRCH1
  Gene Name: leucine-rich repeats and calponin homology (CH) domain containing 1
  Uniprot ID: Q9Y2L9
  ENSP ID: ENSP00000374447
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLSLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSDPALILPPISFNTLTQAQTWDSSSYSVPSEGDSDNVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEADLCSPCDILQLDFRHIRKTVDTLLALGEKAPPPTSALRSRDLIGFCLVHILFIVLVYITYHWNALSA

SEQ ID NO: 45930 - protein, 728 aa, Homo sapiens
  Payload ID: 9383
  Gene Symbol: LRCH1
  Gene Name: leucine-rich repeats and calponin homology (CH) domain containing 1
  Uniprot ID: Q9Y2L9
  ENSP ID: ENSP00000374448
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLSLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEADLCSPCDILQLDFRHIRKTVDTLLALGEKAPPPTSALRSRDLIGFCLVHILFIVLVYITYHWNALSA

SEQ ID NO: 45931 - protein, 98 aa, Homo sapiens
  Payload ID: 9383
  Gene Symbol: LRCH1
  Gene Name: leucine-rich repeats and calponin homology (CH) domain containing 1
  ENSP ID: ENSP00000417121
MKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMS

SEQ ID NO: 45932 - protein, 72 aa, Homo sapiens
  Payload ID: 9383
  Gene Symbol: LRCH1
  Gene Name: leucine-rich repeats and calponin homology (CH) domain containing 1
  ENSP ID: ENSP00000419256
MKQLQVLLLENNPLQSPPAQICTKGKVHIFKYLSIQACQIKTADSLYLHTMERPHLHQHVEDGKKDSDSGVG

SEQ ID NO: 45933 - protein, 765 aa, Homo sapiens
  Payload ID: 9384
  Gene Symbol: LRCH2
  Gene Name: leucine-rich repeats and calponin homology (CH) domain containing 2
  Uniprot ID: Q5VUJ6
  ENSP ID: ENSP00000325091
MAASQGGGGNSGGGGCGGGGSSGGCGTAGGGGGGAGGGGGGGGGTLVVPIPVPTLFGQPFPNGPPWNPGSLQPQHTVRSLDRALEEAGSSGILSLSGRKLRDFPGSGYDLTDTTQADLSRNRFTEIPSDVWLFAPLETLNLYHNCIKTIPEAIKNLQMLTYLNISRNLLSTLPKYLFDLPLKVLVVSNNKLVSIPEEIGKLKDLMELDISCNEIQVLPQQMGKLHSLRELNIRRNNLHVLPDELGDLPLVKLDFSCNKVTEIPVCYRKLHHLQVIILDNNPLQVPPAQICLKGKVHIFKYLNIQACCRMDKKPDSLDLPSLSKRMPSQPLTDSMEDFYPNKNHGPDSGIGSDNGEKRLSTTEPSDDDTVSLHSQVSESNREQTSRNDSHIIGSKTDSQKDQEVYDFVDPNTEDVAVPEQGNAHIGSFVSFFKGKEKCSEKSRKNEELGDEKRLEKEQLLAEEEDDDLKEVTDLRKIAAQLLQQEQKNRILNHSTSVMRNKPKQTVECEKSVSADEVNSPLSPLTWQPLENQKDQIDEQPWPESHPIIWQSEERRRSKQIRKEYFKYKSMRKSSSGNENDEQDSDNANMSTQSPVSSEEYDRTDGFSHSPFGLKPRSAFSRSSRQEYGAADPGFTMRRKMEHLREEREQIRQLRNNLESRLKVILPDDIGAALMDGVVLCHLANHIRPRSVASIHVPSPAVPKLSMAKCRRNVENFLDACKKLGVSQERLCLPHHILEERGLVKVGVTVQALLELPTTKASQLSVA

SEQ ID NO: 45934 - protein, 748 aa, Homo sapiens
  Payload ID: 9384
  Gene Symbol: LRCH2
  Gene Name: leucine-rich repeats and calponin homology (CH) domain containing 2
  Uniprot ID: Q5VUJ6
  ENSP ID: ENSP00000439366
MAASQGGGGNSGGGGCGGGGSSGGCGTAGGGGGGAGGGGGGGGGTLVVPIPVPTLFGQPFPNGPPWNPGSLQPQHTVRSLDRALEEAGSSGILSLSGRKLRDFPGSGYDLTDTTQADLSRNRFTEIPSDVWLFAPLETLNLYHNCIKTIPEAIKNLQMLTYLNISRNLLSTLPKYLFDLPLKVLVVSNNKLVSIPEEIGKLKDLMELDISCNEIQVLPQQMGKLHSLRELNIRRNNLHVLPDELGDLPLVKLDFSCNKVTEIPVCYRKLHHLQVIILDNNPLQVPPAQICLKGKVHIFKYLNIQACCRMDKKPDSLDLPSLSKRMPSQPLTDSMEDFYPNKNHGPDSGIGSDNGEKRLSTTEPSDDDTVSLHSQVSESNREQTSRNDSHIIGSKTDSQKDQEVYDFVDPNTEDVAVPEQGNAHIGSFVSFFKGKEKCSEKSRKNEELGDEKRLEKEQLLAEEEDDDLKEVTDLRKIAAQLLQQEQKNRILNHSTSVMRNKPKQTVECEKSVSADEVNSPLSPLTWQPLENQKDQIDEQPWPESHPIIWQSEERRRSKQIRKEYFKYKSMRKSSSGNENDEEYDRTDGFSHSPFGLKPRSAFSRSSRQEYGAADPGFTMRRKMEHLREEREQIRQLRNNLESRLKVILPDDIGAALMDGVVLCHLANHIRPRSVASIHVPSPAVPKLSMAKCRRNVENFLDACKKLGVSQERLCLPHHILEERGLVKVGVTVQALLELPTTKASQLSVA

SEQ ID NO: 45935 - protein, 712 aa, Homo sapiens
  Payload ID: 9385
  Gene Symbol: LRCH3
  Gene Name: leucine-rich repeats and calponin homology (CH) domain containing 3
  Uniprot ID: Q96II8
  ENSP ID: ENSP00000334375
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVVS

SEQ ID NO: 45936 - protein, 777 aa, Homo sapiens
  Payload ID: 9385
  Gene Symbol: LRCH3
  Gene Name: leucine-rich repeats and calponin homology (CH) domain containing 3
  Uniprot ID: Q96II8
  ENSP ID: ENSP00000393579
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 45937 - protein, 623 aa, Homo sapiens
  Payload ID: 9385
  Gene Symbol: LRCH3
  Gene Name: leucine-rich repeats and calponin homology (CH) domain containing 3
  ENSP ID: ENSP00000394609
MAAAGLVAVAAAAEYSGTVASGGNLPGVHCGPSSGAGPGFGPGSWSRSLDRALEEAAVTGVLSLSGRKLREFPRGAANHDLTDTTRAELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 45938 - protein, 181 aa, Homo sapiens
  Payload ID: 9385
  Gene Symbol: LRCH3
  Gene Name: leucine-rich repeats and calponin homology (CH) domain containing 3
  ENSP ID: ENSP00000394763
  MOD_RES (1)..(1): Any amino acid
XKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQDNLCSPSDILQLNLSVKRTVETLLSLGAHSEESSFVCLSLQLLGFVAFYCTVMLTLCVLYYWLFPAR

SEQ ID NO: 45939 - protein, 725 aa, Homo sapiens
  Payload ID: 9385
  Gene Symbol: LRCH3
  Gene Name: leucine-rich repeats and calponin homology (CH) domain containing 3
  Uniprot ID: Q96II8
  ENSP ID: ENSP00000394965
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 45940 - protein, 227 aa, Homo sapiens
  Payload ID: 9385
  Gene Symbol: LRCH3
  Gene Name: leucine-rich repeats and calponin homology (CH) domain containing 3
  ENSP ID: ENSP00000395309
YEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQDNLCSPSDILQLNLSV

SEQ ID NO: 45941 - protein, 803 aa, Homo sapiens
  Payload ID: 9385
  Gene Symbol: LRCH3
  Gene Name: leucine-rich repeats and calponin homology (CH) domain containing 3
  Uniprot ID: Q96II8
  ENSP ID: ENSP00000399751
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQDNLCSPSDILQLNLSVKRTVETLLSLGAHSEESSFVCLSLQLLGFVAFYCTVMLTLCVLYYWLFPAR

SEQ ID NO: 45942 - protein, 214 aa, Homo sapiens
  Payload ID: 9385
  Gene Symbol: LRCH3
  Gene Name: leucine-rich repeats and calponin homology (CH) domain containing 3
  ENSP ID: ENSP00000400164
AVLDFVKQKASQSPQKQHPLLDGVDGECPFPSRRSQHTDDSALCMSDDRPNALLSSPATETGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 45943 - protein, 92 aa, Homo sapiens
  Payload ID: 9385
  Gene Symbol: LRCH3
  Gene Name: leucine-rich repeats and calponin homology (CH) domain containing 3
  ENSP ID: ENSP00000412975
MAAAGLVAVAAAAEYSGTVASGGNLPGVHCGPSSGAGPGFGPGSWSRSLDRALEEAAVTGVLSLSGRKLREFPRGAANHDLTDTTRAGCELQ

SEQ ID NO: 45944 - protein, 683 aa, Homo sapiens
  Payload ID: 9386
  Gene Symbol: LRCH4
  Gene Name: leucine-rich repeats and calponin homology (CH) domain containing 4
  Uniprot ID: O75427
  ENSP ID: ENSP00000309689
MAAAVAAPLAAGGEEAAATTSVPGSPGLPGRRSAERALEEAVATGTLNLSNRRLKHFPRGAARSYDLSDITQADLSRNRFPEVPEAACQLVSLEGLSLYHNCLRCLNPALGNLTALTYLNLSRNQLSLLPPYICQLPLRVLIVSNNKLGALPPDIGTLGSLRQLDVSSNELQSLPSELCGLSSLRDLNVRRNQLSTLPEELGDLPLVRLDFSCNRVSRIPVSFCRLRHLQVILLDSNPLQSPPAQVCLKGKLHIFKYLSTEAGQRGSALGDLAPSRPPSFSPCPAEDLFPGHRYDGGLDSGFHSVDSGSKRWSGNESTDEFSELSFRISELAREPRGPRERKEDGSADGDPVQIDFIDSHVPGEDEERGTVEEQRPPELSPGAGDRERAPSSRREEPAGEERRRPDTLQLWQERERRQQQQSGAWGAPRKDSLLKPGLRAVVGGAAAVSTQAMHNGSPKSSASQAGAAAGQGAPAPAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEADLCSPSDLLQGTARGLRTALEAVKRVGGKALPPLWPPSGLGGFVVFYVVLMLLLYVTYTRLLGS

SEQ ID NO: 45945 - protein, 177 aa, Homo sapiens
  Payload ID: 9386
  Gene Symbol: LRCH4
  Gene Name: leucine-rich repeats and calponin homology (CH) domain containing 4
  ENSP ID: ENSP00000419674
  MOD_RES (1)..(1): Any amino acid
XAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEESLCQPHHILEEEGAPGRGLPYIAAVVHALLDRP

SEQ ID NO: 45946 - protein, 231 aa, Homo sapiens
  Payload ID: 9386
  Gene Symbol: LRCH4
  Gene Name: leucine-rich repeats and calponin homology (CH) domain containing 4
  ENSP ID: ENSP00000419870
MHNGSPKSSASQAGAAAGQGAPAPAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEADLCSPSDLLQGTARGLRTALEAVKRVGGKALPPLWPPSGLGGFVVFYVVLMLLLYVTYTRLLGS

SEQ ID NO: 45947 - protein, 142 aa, Homo sapiens [sequence omitted]

SEQ ID NO: 45948 - protein, 116 aa, Homo sapiens
  Payload ID: 9387
  Gene Symbol: LRRD1
  Gene Name: leucine-rich repeats and death domain containing 1
  Uniprot ID: A4D1F6
  ENSP ID: ENSP00000339642
MTQLKELDISNNAIREIPRNIGELRNLVSLHAYNNQISYLPPSLLSLNDLQQLNLSGNNLTALPSAIYNIFSLKEINFDDNPLLRPPVEICKGKQLYTIARYLQRADERDGLQLHS

SEQ ID NO: 45949 - protein, 59 aa, Homo sapiens
  Payload ID: 9387
  Gene Symbol: LRRD1
  Gene Name: leucine-rich repeats and death domain containing 1
  ENSP ID: ENSP00000387628
MSEKEGMSEVLEDTISQFRKESRSQSMKEPGFIKETSNLINEASDYLEGKSSNQIYETH

SEQ ID NO: 45950 - protein, 860 aa, Homo sapiens
  Payload ID: 9387
  Gene Symbol: LRRD1
  Gene Name: leucine-rich repeats and death domain containing 1
  Uniprot ID: A4D1F6
  ENSP ID: ENSP00000405987
MSEKEGMSEVLEDTISQFRKESRSQSMKEPGFIKETSNLINEASDYLEGKSSNQIYETHPRQNTLESTSSSGRKSKRNEEQKKNLQFSETSTRTGTSQSLSSLTGRTAEYQALVNFLSHETVGEVSPQVSEENQKQLGLGADNFTVNLEAKGLQEFPKDILKIKYVKYLYLDKNQIKTFQGADSGDLLGLEILSLQENGLSSLPSEIQLLHNLRILNVSHNHISHIPKEISQLGNIRQLFFYNNYIENFPSDLECLGNLEILSLGKNKLRHIPDTLPSLKTLRVLNLEYNQLTTFPKALCFLPKLISLDLTGNLISSLPKEIRELKNLETLLMDHNKLTFLAVEIFQLLKIKELQLADNKLEVISHKIENFRELRILILDKNLLKNIPEKISCCAMLECLSLSDNKLTELPKYIHKLNNLRKLHVNRNNMVKITDCISHLNNICSLEFSGNIITDVPIEIKNCQKIIKIELSYNKIMYFPLGLCALDSLYYLSVNGNYISEIPVDISFSKQLLHLELSENKLLIFSEHFCSLINLKYLDLGKNQIKKIPASISNMISLHVLILCCNKFETFPRELCTLENLQVLDLSENQLQKISSDICNLKGIQKLNFSSNQFIHFPIELCQLQSLEQLNISQIKGRKLTRLPGELSNMTQLKELDISNNAIREIPRNIGELRNLVSLHAYNNQISYLPPSLLSLNDLQQLNLSGNNLTALPSAIYNIFSLKEINFDDNPLLRPPVEICKGKQLYTIARYLQRADERDEKILEKIFKIVANNITETNFEFLCQKLNLANSETDMPTKSTVSLSERAHQALVIWKTQSNKLSLTAAALRDQLIRALTMIGAYEIMDKITALNLFTRAIKF

SEQ ID NO: 45951 - protein, 860 aa, Homo sapiens; identical to SEQ ID NO: 45950
  Payload ID: 9387
  Gene Symbol: LRRD1
  Gene Name: leucine-rich repeats and death domain containing 1
  Uniprot ID: A4D1F6
  ENSP ID: ENSP00000411568

SEQ ID NO: 45952 - protein, 825 aa, Homo sapiens
  Payload ID: 9388
  Gene Symbol: LRGUK
  Gene Name: leucine-rich repeats and guanylate kinase domain containing
  Uniprot ID: Q96M69
  ENSP ID: ENSP00000285928
MATSERALLRTRAASLLRGLGRSRTGARSLQFRAEKERQPCWSFPMGQKTKGSSNIASSYLLQQLMHRYQELDSDGDEDQGEGEAGSEESSESEMLNLEEEFDGVLREEAVAKALHHLGRSGSGTEQVYLNLTLSGCNLIDVSILCGYVHLQKLDLSANKIEDLSCVSCMPYLLELNASQNNLTTFFNFKPPKNLKKADFSHNQISEICDLSAYHALTKLILDGNEIEEISGLEMCNNLIHLSLANNKITTINGLNKLPIKILCLSNNQIEMITGLEDLKALQNLDLSHNQISSLQGLENHDLLEVINLEDNKIAELREIEYIKNLPILRVLNLLENPIQEKSEYWFFVIFMLLRLTELDQKKIKVEEKVSAVNKYDPPPEVVAAQDHLTHVVNSVMQPQRIFDSTLPSLDAPYPMLILAGPEACGKRELAHRLCRQFSTYFRYGACHTTRPPYFGEGDRVDYHFISQDVFDEMVNMGKFILTFSYGNHKYGLNRDTVEGIARDGLASCIHMEIEGVRSLKYSYFEPRYILVVPMNKEKYEGYLRRKGLFSRAEIEFAVSRVDLYIKINQNFPGYFDEVINADDLDVAYQKLSQLIREYLGLTEEPAKSLATTADVKTSHLKPEAHPTKYISSNMGDFLHSTDRNYLIKFWAKLSAKKTPAERDSIHRQHEAARQALMGRIRPDHTLLFQRGPVPAPLTSGLHYYTTLEELWKSFDLCEDYFKPPFGPYPEKSGKDSLVSMKCSLFRFCPWSKELPFQPPEGSISSHLGSGASDSETEETRKALPIQSFSHEKESHQHRQHSVPVISRPGSNVKPTLPPIPQGRR

SEQ ID NO: 45953 - protein, 1093 aa, Homo sapiens
  Payload ID: 9389
  Gene Symbol: LRIG1
  Gene Name: leucine-rich repeats and immunoglobulin-like domains 1
  Uniprot ID: Q96JA1
  ENSP ID: ENSP00000273261
MARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 45954 - protein, 1070 aa, Homo sapiens
  Payload ID: 9389
  Gene Symbol: LRIG1
  Gene Name: leucine-rich repeats and immunoglobulin-like domains 1
  Uniprot ID: Q96JA1
  ENSP ID: ENSP00000373208
MARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLLLLEPSQSAGCSSPSQPHMSAGGRTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAAQTPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 45955 - protein, 1065 aa, Homo sapiens
  Payload ID: 9390
  Gene Symbol: LRIG2
  Gene Name: leucine-rich repeats and immunoglobulin-like domains 2
  Uniprot ID: O94898
  ENSP ID: ENSP00000355396
MAPAPLGVPEEQLLGCRSRVLSRLLFIAQTALLLLPAAGAGLCPAPCSCRIPLLDCSRRKLPAPSWRALSGLLPPDTAILDFSHNRLSNWNISLESQTLQEVKMNYNELTEIPYFGEPTSNITLLSLVHNIIPEINAQALQFYPALESLDLSSNIISEIKTSSFPRMQLKYLNLSNNRITTLEAGCFDNLSSSLLVVKLNRNRMSMIPPKIFKLPHLQFLELKRNRIKIVEGLTFQGLDSLRSLKMQRNGISKLKDGAFFGLNNMEELELEHNNLTRVNKGWLYGLRMLQQLYVSQNAIERISPDAWEFCQRLSELDLSYNQLTRLDESAFVGLSLLERLNLGDNRVTHIADGVFRFLSNLQTLDLRNNEISWAIEDASEAFAGLTSLTKLILQGNQIKSITKKAFIGLESLEHLDLNNNAIMSIQENAFSQTHLKELILNTSSLLCDCHLKWLLQWLVDNNFQHSVNVSCAHPEWLAGQSILNVDLKDFVCDDFLKPQIRTHPETIIALRGMNVTLTCTAVSSSDSPMSTVWRKDSEILYDVDTENFVRYWQQAGEALEYTSILHLFNVNFTDEGKYQCIVTNHFGSNYSQKAKLTVNEMPSFLKTPMDLTIRTGAMARLECAAEGHPAPQISWQKDGGTDFPAARERRMHVMPEDDVFFIANVKIEDMGIYSCMAQNTAGGLSANASLTVLETPSFIRPLEDKTVTRGETAVLQCIAGGSPAPRLNWTKDDGPLLVTERHFFAAANQLLIIVDAGLEDAGKYTCIMSNTLGTERGHIYLNVISSPNCDSSQSSIGHEDDGWTTVGIVIIVVVCCVVGTSLIWVIVIYHMRRKNEDYSITNTEELNLPADIPSYLSSQGTLSEPQEGYSNSEAGSHQQLMPPANGYIHKGTDGGTGTRVICSDCYDNANIYSRTREYCPYTYIAEEDVLDQTLSSLMVQMPKETYLVHPPQDTTALESLIPSANREPSAFPTNHERISEKKLPSTQMSGETLQRPVWNINRELGLPHPPFSQQPVHESPQLHQNEGLAGREPDCSASSMSCHRLQDHAFDFSRTRNIQDGSEGT

SEQ ID NO: 45956 - protein, 1119 aa, Homo sapiens
  Payload ID: 9391
  Gene Symbol: LRIG3
  Gene Name: leucine-rich repeats and immunoglobulin-like domains 3
  Uniprot ID: Q6UXM1
  ENSP ID: ENSP00000326759
MSAPSLRARAAGLGLLLCAVLGRAGRSDSGGRGELGQPSGVAAERPCPTTCRCLGDLLDCSRKRLARLPEPLPSWVARLDLSHNRLSFIKASSMSHLQSLREVKLNNNELETIPNLGPVSANITLLSLAGNRIVEILPEHLKEFQSLETLDLSSNNISELQTAFPALQLKYLYLNSNRVTSMEPGYFDNLANTLLVLKLNRNRISAIPPKMFKLPQLQHLELNRNKIKNVDGLTFQGLGALKSLKMQRNGVTKLMDGAFWGLSNMEILQLDHNNLTEITKGWLYGLLMLQELHLSQNAINRISPDAWEFCQKLSELDLTFNHLSRLDDSSFLGLSLLNTLHIGNNRVSYIADCAFRGLSSLKTLDLKNNEISWTIEDMNGAFSGLDKLRRLILQGNRIRSITKKAFTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNMLPSFTKTPMDLTIRAGAMARLECAAVGHPAPQIAWQKDGGTDFPAARERRMHVMPEDDVFFIVDVKIEDIGVYSCTAQNSAGSISANATLTVLETPSFLRPLLDRTVTKGETAVLQCIAGGSPPPKLNWTKDDSPLVVTERHFFAAGNQLLIIVDSDVSDAGKYTCEMSNTLGTERGNVRLSVIPTPTCDSPQMTAPSLDDDGWATVGVVIIAVVCCVVGTSLVWVVIIYHTRRRNEDCSITNTDETNLPADIPSYLSSQGTLADRQDGYVSSESGSHHQFVTSSGAGFFLPQHDSSGTCHIDNSSEADVEAATDLFLCPFLGSTGPMYLKGNVYGSDPFETYHTGCSPDPRTVLMDHYEPSYIKKKECYPCSHPSEESCERSFSNISWPSHVRKLLNTSYSHNEGPGMKNLCLNKSSLDFSANPEPASVASSNSFMGTFGKALRRPHLDAYSSFGQPSDCQPRAFYLKAHSSPDLDSGSEEDGKERTDFQEENHICTFKQTLENYRTPNFQSYDLDT

SEQ ID NO: 45957 - protein, 1059 aa, Homo sapiens
  Payload ID: 9391
  Gene Symbol: LRIG3
  Gene Name: leucine-rich repeats and immunoglobulin-like domains 3
  Uniprot ID: Q6UXM1
  ENSP ID: ENSP00000368436
MVDVLLLFSLCLLFHISRPDLSHNRLSFIKASSMSHLQSLREVKLNNNELETIPNLGPVSANITLLSLAGNRIVEILPEHLKEFQSLETLDLSSNNISELQTAFPALQLKYLYLNSNRVTSMEPGYFDNLANTLLVLKLNRNRISAIPPKMFKLPQLQHLELNRNKIKNVDGLTFQGLGALKSLKMQRNGVTKLMDGAFWGLSNMEILQLDHNNLTEITKGWLYGLLMLQELHLSQNAINRISPDAWEFCQKLSELDLTFNHLSRLDDSSFLGLSLLNTLHIGNNRVSYIADCAFRGLSSLKTLDLKNNEISWTIEDMNGAFSGLDKLRRLILQGNRIRSITKKAFTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNMLPSFTKTPMDLTIRAGAMARLECAAVGHPAPQIAWQKDGGTDFPAARERRMHVMPEDDVFFIVDVKIEDIGVYSCTAQNSAGSISANATLTVLETPSFLRPLLDRTVTKGETAVLQCIAGGSPPPKLNWTKDDSPLVVTERHFFAAGNQLLIIVDSDVSDAGKYTCEMSNTLGTERGNVRLSVIPTPTCDSPQMTAPSLDDDGWATVGVVIIAVVCCVVGTSLVWVVIIYHTRRRNEDCSITNTDETNLPADIPSYLSSQGTLADRQDGYVSSESGSHHQFVTSSGAGFFLPQHDSSGTCHIDNSSEADVEAATDLFLCPFLGSTGPMYLKGNVYGSDPFETYHTGCSPDPRTVLMDHYEPSYIKKKECYPCSHPSEESCERSFSNISWPSHVRKLLNTSYSHNEGPGMKNLCLNKSSLDFSANPEPASVASSNSFMGTFGKALRRPHLDAYSSFGQPSDCQPRAFYLKAHSSPDLDSGSEEDGKERTDFQEENHICTFKQTLENYRTPNFQSYDLDT

SEQ ID NO: 45958 - protein, 623 aa, Homo sapiens
  Payload ID: 9391
  Gene Symbol: LRIG3
  Gene Name: leucine-rich repeats and immunoglobulin-like domains 3
  ENSP ID: ENSP00000413143
MSAPSLRARAAGLGLLLCAVLGRAGRSDSGGRGELGQPSGVAAERPCPTTCRCLGDLLDCSRKRLARLPEPLPSWVARLDLSHNRLSFIKASSMSHLQSLREVKLNNNELETIPNLGPVSANITLLSLAGNRIVEILPEHLKEFQSLETLDLSSNNISELQTAFPALQLKYLYLNSNRVTSMEPGYFDNLANTLLVLKLNRNRISAIPPKMFKLPQLQHLELNRNKIKNVDGLTFQGLGALKSLKMQRNGVTKLMDGAFWGLSNMEILQLDHNNLTEITKGWLYGLLMLQELHLSQNAINRISPDAWEFCQKLSELDLTFNHLSRLDDSSFLGLSLLNTLHIGNNRVSYIADCAFRGLSSLKTLDLKNNEISWTIEDMNGAFSGLDKLRRLILQGNRIRSITKKAFTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNIPHLTLPFPTFHSTKLRFLVICI

SEQ ID NO: 45959 - protein, 156 aa, Homo sapiens
  Payload ID: 9391
  Gene Symbol: LRIG3
  Gene Name: leucine-rich repeats and immunoglobulin-like domains 3
  ENSP ID: ENSP00000449109
MSHLQSLREVKLNNNELETIPNLGPVSANITLLSLAGNRIVEILPEHLKEFQSLETLDLSSNNISELQTAFPALQLKYLYLNSNRVTSMEPGYFDNLANTLLVLKLNRNRISAIPPKMFKLPQLQHLELNRNKIKNVDGLTFQGLGALKSLKMQRN

SEQ ID NO: 45960 - protein, 163 aa, Homo sapiens
  Payload ID: 9391
  Gene Symbol: LRIG3
  Gene Name: leucine-rich repeats and immunoglobulin-like domains 3
  ENSP ID: ENSP00000449169
  MOD_RES (1)..(1): Any amino acid
XTCHIDNSSEADVEAATDLFLCPFLGSTGPMYLKGNVYGSDPFETYHTGCSPDPRTVLMDHYEPSYIKKKECYPCSHPSEESCERSFSNISWPSHVRKLLNTSYSHNEGPGMKNLCLNKSSLDFSANPEPASVASSNSFMGKFIKLSGTSSEDPYSKLCVREQ

SEQ ID NO: 45961 - protein, 164 aa, Homo sapiens
  Payload ID: 9392
  Gene Symbol: LRRIQ1
  Gene Name: leucine-rich repeats and IQ motif containing 1
  ENSP ID: ENSP00000376906
MDDDDAKLKAEIEAELDKLSISSLEKEDIESDAKSETQSDDSDTDSVELPESVLHCINIIKNRSKAVEELILQDLEDTDILSCSYGAVSNNHMHLRTGLSTEYEESSEQLIKILSEIEKEEFMRSKTDCATPDFVPEPSPHDLPMDEHVLPDDADINFGYCEVE

SEQ ID NO: 45962 - protein, 1722 aa, Homo sapiens
  Payload ID: 9392
  Gene Symbol: LRRIQ1
  Gene Name: leucine-rich repeats and IQ motif containing 1
  Uniprot ID: Q96JM4
  ENSP ID: ENSP00000376910
MDDDDAKLKAEIEAELDKLSISSLEKEDIESDAKSETQSDDSDTDSVELPESVLHCINIIKNRSKAVEELILQDLEDTDILSCSYGAVSNNHMHLRTGLSTEYEESSEQLIKILSEIEKEEFMRSKTDCATPDFVPEPSPHDLPMDEHVLPDDADINFGYCEVEEKCRQSFEAWQEKQKELEDKEKQTLKAQRDREEKQFQEEEEKRHCWMKQFKVEKKKLENIQKQEQDKMNDELYKEEKIWKEKFKQHEEYIRNLHLQMEEERTRFKDQQEKEKNSLLKQQNNAAVKIQAKYKAFVAYQKYGPIIKEQIESKKRKAQEWKEKEAKIRQKEEENRKRLEEEQRIKEERKKQKEEERKRREKEYEEKKNIVKQEREQLISKEKIILREDASQQLIISSALKKSGYNNKHLSLEDISNDKGDIAKNLVDENSKKQEDVLLWLVEESNMKENVDRQTILKESIQVKLKESISSQTILADFKMEEKNENLAKKRCSEELVKQERKYENTDNKTELGNSDLKGNLKEQFPLQELKSDAQKEEKIMKHVINENTGQKTQIILGHNQEISEVKTNEEQKIIKDNQQKKIQKVEKEEIQEQNGLLYKDKDTLVISVKQRSLSLTSENSKDVRENVILQEKEIYSKSKEIEENPKDNAWNSGIVIFNTTDTMINIEGKRNDQDYVLGRHAPCEGLSNYNAESSMVSKEVNSLKSEIRNISEKCHENAPEPDSMTCCVSESTLLYSIEERRLAWIKSFKPWLEIFKQNQQKKIVRRKRPVKCPANMTPALDKLEILRCGPWDTLQQVTTVTFQDLPGCVLSTLAECTNLQFLSLRRCGLTSLHSLSNCKKLKYIDAQENHIEAIECENLENLCVVLLNKNQLTSLHGLDGCTNIQCLELSYNKITRIGYSFFLEEKLVDNAGFCHHLGTSTSYLSLAQVWIPTGLCWSWIPITSLTKNSDCNFLISHLYWNCGLESLKNLQQLILDHNQLINTKGLCDTPTIVYLDCSHNHLTDVEGVENCGLLQILKLQGNYLSELPSLENLVLLRELHLDDNSISTVEAFSSYWLPLLQNITISQNSLTKIVPLFHFVSLEKLDVSHNCLSDLKSAIKWFDACYSLHELSLTGNPLLQETNWRDSLLKVLPALRILNGNILNSNSESRTEEHNQLGSAGFLALCQSQIREFNLLIENYITGKGDVFTLDTAENLCHYFKKLMILSTEYRHAHERGDVTITKKDESEAQKNHLAPTNSDSTLQNGVFYSCAREGEPDSPDIPEKWMDSVSSHSPLSKSATCENMEGRHQEILVCQKREDSKASSIPTIRIPFKEVVMTNSLLRNHQNIEPSEKIMAAVVIQSYWRGYLMRRQTHFSTRLHTAATEGLPNSSIKNQTILKKGKRENIVNIRKQREKAAILIQAVWKGFILRKKLTTALEAIKNEESDEEYREIDLEDFIFDEAALEEEWLALDSTRFPSQTLLLSNQLHWPKIPGNLKWDDTSFNLPSNPAQAWLCNDKENLSSSEHTQFNSRSENKTSSWTPESKTSRKSLLKSEKEKKISEEWGFKDISTAQQMLKRAQKMKSKKLKKKIDSTVRLALFKNNENKVSLPKSPKMVQPRRDGYFEGIEEDPIHKDTTANEKLERNREYTYQWLHTQVGVHETTSSRNMKCNHFLPELDPDVLNGGRVQLVARLVSREDTDLDLFSMTNGSALSVNREKKNQAHRHSAGSSSKLWFPSKLI

SEQ ID NO: 45963 - protein, 107 aa, Homo sapiens
  Payload ID: 9392
  Gene Symbol: LRRIQ1
  Gene Name: leucine-rich repeats and IQ motif containing 1
  ENSP ID: ENSP00000431756
  MOD_RES (1)..(1): Any amino acid
XLFKNNENKVSLPKSPKMVQPRRDGYFEGIEEDPIHKDTTANEKLERNREYTYQWLHTQVGVHETTSSRNMKCNHFLPELDPDVLNGGRVQLVVRNVLKVTEKCCRH

SEQ ID NO: 45964 - protein, 144 aa, Homo sapiens
  Payload ID: 9392
  Gene Symbol: LRRIQ1
  Gene Name: leucine-rich repeats and IQ motif containing 1
  ENSP ID: ENSP00000436898
  MOD_RES (1)..(1): Any amino acid
XEESSEQLIKILSEIEKEEFMRSKTDCATPDFVPEPSPHDLPMDEHVLPDDADINFGYCEVEEKCRQSFEAWQEKQKELEDKEKQTLKAQRDREEKQFQEEEEKRHCWMKQFKVEKKKLENIQKEYIRNLHLQMEEERTRFKDQ

SEQ ID NO: 45965 - protein, 624 aa, Homo sapiens
  Payload ID: 9393
  Gene Symbol: LRRIQ3
  Gene Name: leucine-rich repeats and IQ motif containing 3
  Uniprot ID: A6PVS8
  ENSP ID: ENSP00000346414
MFHGTVTEELTSHEEWSHYNENIREGQKDFVFVKFNGLHLKSMENLQSCISLRVCIFSNNFITDIHPLQSCIKLIKLDLHGNQIKSLPNTKFWNGLKNLKLLYLHDNGFAKLKNICVLSACPTLIALTMFDCPVSLKKGYRHVLVNSIWPLKALDHHVISDEEIIQNWHLPERFKACNHRLFFNFCPALRKGTTYEEEINNIKHITSKINAILAHNSPVLIVQRWIRGFLVRKNLSPVFFHKKKQQEKIIRGYEAKWIYITKGYEDKLLKDLFFKPETNIKGKLAYWKHNIYYPVDLKNSSEHRKHVSSILCELKPKDLGMKSKTSRHLIQKGQESEDEIVDEKLDTSFRISVFKLPIYTSGSLKNNAVLREKKQHFFPAYPQPIYTTHPKPIIKKDIRLERSMKEFFAPQRAGMKLRTFSDIDKYYTEQKKQEYHKEKVRVVAMAQVARERVRVAVNEHLNQKKYATQKLIEENKETIQNSLRQVWQNRFNYLEKARERKALFLKEKSQKASERLLVQNLNNERTLLTRGLLKIDRLEKNEAVLKEKSLIVKQKLKAEKYRKNLLKEMKKVRSQEIYKRHCEEKFVMDMIAFEKACERLQDAKTKVAIVKTNLDFKVPNGLIK

SEQ ID NO: 45966 - protein, 191 aa, Homo sapiens
  Payload ID: 9393
  Gene Symbol: LRRIQ3
  Gene Name: leucine-rich repeats and IQ motif containing 3
  ENSP ID: ENSP00000359946
MFHGTVTEELTSHEEWSHYNENIREGQKDFVFVKFNGLHLKSMENLQSCISLRVCIFSNNFITDIHPLQSCIKLIKLDLHGNQGTTYEEEINNIKHITSKINAILAHNSPVLIVQRWIRGFLVRKNLSPVFFHKKKQQEKIIRGYEAKWIYITKGYEDKLLKDLFFKPETNIKGKLAYWKHDKKKLWVNFH

SEQ ID NO: 45967 - protein, 199 aa, Homo sapiens
  Payload ID: 9393
  Gene Symbol: LRRIQ3
  Gene Name: leucine-rich repeats and IQ motif containing 3
  Uniprot ID: A6PVS8
  ENSP ID: ENSP00000359948
MFHGTVTEELTSHEEWSHYNENIREGQKDFVFVKFNGLHLKSMENLQSCISLRVCIFSNNFITDIHPLQSCIKLIKLDLHGNQIKSLPNTKFWNGLKNLKLLYLHDNGFAKLKNICVLSACPTLIALTMFDCPVSLKKGYRHVLVNSIWPLKALDHHVISDEEIIQNWHLPERFKACNHRLFFNFCPALRKEKMKHSEV

SEQ ID NO: 45968 - protein, 624 aa, Homo sapiens; identical to SEQ ID NO: 45965
  Payload ID: 9393
  Gene Symbol: LRRIQ3
  Gene Name: leucine-rich repeats and IQ motif containing 3
  Uniprot ID: A6PVS8
  ENSP ID: ENSP00000378524

SEQ ID NO: 45969 - protein, 60 aa, Homo sapiens
  Payload ID: 9393
  Gene Symbol: LRRIQ3
  Gene Name: leucine-rich repeats and IQ motif containing 3
  ENSP ID: ENSP00000390376
NIYYPVDLKNSSEHRKHVSSILCELKPKDLGMKSKTSRHLIQKDLKKYIKDIVKKNLLWI

SEQ ID NO: 45970 - protein, 105 aa, Homo sapiens
  Payload ID: 9393
  Gene Symbol: LRRIQ3
  Gene Name: leucine-rich repeats and IQ motif containing 3
  ENSP ID: ENSP00000398289
  MOD_RES (1)..(1): Any amino acid
XNNFITDIHPLQSCIKLIKLDLHGNQGTTYEEEINNIKHITSKINAILAHNSPVLIVQRWIRGFLVRKNLRLLQSSEFKDCLKMCPRKREKKNIFFLIFKLIEKY

SEQ ID NO: 45971 - protein, 299 aa, Homo sapiens
  Payload ID: 9393
  Gene Symbol: LRRIQ3
  Gene Name: leucine-rich repeats and IQ motif containing 3
  Uniprot ID: A6PVS8
  ENSP ID: ENSP00000415319
MFHGTVTEELTSHEEWSHYNENIREGQKDFVFVKFNGLHLKSMENLQSCISLRVCIFSNNFITDIHPLQSCIKLIKLDLHGNQIKSLPNTKFWNGLKNLKLLYLHDNGFAKLKNICVLSACPTLIALTMFDCPVSLKKGYRHVLVNSIWPLKALDHHVISDEEIIQNWHLPERFKACNHRLFFNFCPALRKGTTYEEEINNIKHITSKINAILAHNSPVLIVQRWIRGFLVRKNLSPVFFHKKKQQEKIIRGYEAKWIYITKGYEDKLLKDLFFKPETNIKGKLAYWKHDKKKLWVNFH

SEQ ID NO: 45972 - protein, 560 aa, Homo sapiens
  Payload ID: 9394
  Gene Symbol: LRRIQ4
  Gene Name: leucine-rich repeats and IQ motif containing 4
  Uniprot ID: A6NIV6
  ENSP ID: ENSP00000342188
MSKDIKSVEHSPKIHQRNDPQHVNDRTFFIDASNQSLTAIPLEIFTFTELEEVHLENNQIEEIPQEIQRLKNIRVLYLDKNNLRSLCPALGLLSSLESLDLSYNPIFSSSLVVVSFLHALRELRLYQTDLKEIPVVIFKNLHHLELLGLTGNHLKCLPKEIVNQTKLREIYLKRNQFEVFPQELCVLYTLEIIDLDENKIGAIPEEIGHLTGLQKFYMASNNLPVLPASLCQCSQLSVLDLSHNLLHSIPKSFAELRKMTEIGLSGNRLEKVPRLICRWTSLHLLYLGNTGLHRLRGSFRCLVNLRFLDLSQNHLHHCPLQICALKNLEVLGLDDNKIGQLPSELGSLSKLKILGLTGNEFLSFPEEVLSLASLEKLYIGQDQGFKLTYVPEHIRKLQSLKELYIENNHLEYLPVSLGSMPNLEVLDCRHNLLKQLPDAICQAQALKELRLEDNLLTHLPENLDSLVNLKVLTLMDNPMEEPPKEVCAEGNEAIWKYLKENRNRNIMATKIQAWWRGTMVQRGFGKFGELLKPQKKGKTSPKDKKGKKDVKGKPGKGKKK

SEQ ID NO: 45973 - protein, 345 aa, Homo sapiens
  Payload ID: 9395
  Gene Symbol: LRTM1
  Gene Name: leucine-rich repeats and transmembrane domains 1
  Uniprot ID: Q9HBL6
  ENSP ID: ENSP00000273286
MKGELLLFSSVIVLLQVVCSCPDKCYCQSSTNFVDCSQQGLAEIPSHLPPQTRTLHLQDNQIHHLPAFAFRSVPWLMTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGGLTDGIICESPDTWKGKDLLRIPHELYQPCPLPAPDPVSSQAQWPGSAHGVVLRPPENHNAGERELLECELKPKPRPANLRHAIATVIITGVVCGIVCLMMLAAAIYGCTYAAITAQYHGGPLAQTNDPGKVEEKERFDSSPA

SEQ ID NO: 45974 - protein, 269 aa, Homo sapiens
  Payload ID: 9395
  Gene Symbol: LRTM1
  Gene Name: leucine-rich repeats and transmembrane domains 1
  Uniprot ID: Q9HBL6
  ENSP ID: ENSP00000419772
MTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGGLTDGIICESPDTWKGKDLLRIPHELYQPCPLPAPDPVSSQAQWPGSAHGVVLRPPENHNAGERELLECELKPKPRPANLRHAIATVIITGVVCGIVCLMMLAAAIYGCTYAAITAQYHGGPLAQTNDPGKVEEKERFDSSPA

SEQ ID NO: 45975 - protein, 370 aa, Homo sapiens
  Payload ID: 9396
  Gene Symbol: LRTM2
  Gene Name: leucine-rich repeats and transmembrane domains 2
  Uniprot ID: Q8N967
  ENSP ID: ENSP00000299194
MLAPGSSPGQRGRLALQWRQVSWITCWIALYAVEALPTCPFSCKCDSRSLEVDCSGLGLTTVPPDVPAATRTLLLLNNKLSALPSWAFANLSSLQRLDLSNNFLDRLPRSIFGDLTNLTELQLRNNSIRTLDRDLLRHSPLLRHLDLSINGLAQLPPGLFDGLLALRSLSLRSNRLQNLDRLTFEPLANLQLLQVGDNPWECDCNLREFKHWMEWFSYRGGRLDQLACTLPKELRGKDMRMVPMEMFNYCSQLEDENSSAGLDIPGPPCTKASPEPAKPKPGAEPEPEPSTACPQKQRHRPASVRRAMGTVIIAGVVCGVVCIMMVVAAAYGCIYASLMAKYHRELKKRQPLMGDPEGEHEDQKQISSVA

SEQ ID NO: 45976 - protein, 93 aa, Homo sapiens
  Payload ID: 9396
  Gene Symbol: LRTM2
  Gene Name: leucine-rich repeats and transmembrane domains 2
  ENSP ID: ENSP00000438678
MLAPGSSPGQRGRLALQWRQVSWITCWIALYAVEALPTCPFSCKCDSRSLEVDCSGLGLTTVPPDVPAATRTLLLLNNKLSALPSWAFANLSS

SEQ ID NO: 45977 - protein, 95 aa, Homo sapiens
  Payload ID: 9396
  Gene Symbol: LRTM2
  Gene Name: leucine-rich repeats and transmembrane domains 2
  ENSP ID: ENSP00000444104
MLAPGSSPGQRGRLALQWRQVSWITCWIALYAVEALPTCPFSCKCDSRSLEVDCSGLGLTTVPPDVPAATRTLLLLNNKLSALPSWAFANLSSLQ

SEQ ID NO: 45978 - protein, 370 aa, Homo sapiens; identical to SEQ ID NO: 45975
  Payload ID: 9396
  Gene Symbol: LRTM2
  Gene Name: leucine-rich repeats and transmembrane domains 2
  Uniprot ID: Q8N967
  ENSP ID: ENSP00000444737

SEQ ID NO: 45979 - protein, 370 aa, Homo sapiens; identical to SEQ ID NO: 45975
  Payload ID: 9396
  Gene Symbol: LRTM2
  Gene Name: leucine-rich repeats and transmembrane domains 2
  Uniprot ID: Q8N967
  ENSP ID: ENSP00000446278

SEQ ID NO: 45980 - protein, 647 aa, Homo sapiens
  Payload ID: 9397
  Gene Symbol: LRWD1
  Gene Name: leucine-rich repeats and WD repeat domain containing 1
  Uniprot ID: Q9UFC0
  ENSP ID: ENSP00000292616
MGPLSARLLMQRGRPKSDRLGKIRSLDLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEEGATSQTVATCGGEAVCVIDCQTGIVLHKYKAPGEEFFSVAWTALMVVTQAGHKKRWSVLAAAGLRGLVRLLHVRAGFCCGVIRAHKKAIATLCFSPAHETHLFTASYDKRIILWDIGVPNQDYEFQASQLLTLDTTSIPLRLCPVASCPDARLLAGCEGGCCCWDVRLDQPQKRRVCEVEFVFSEGSEASGRRVDGLAFVNEDIVASKGSGLGTICLWSWRQTWGGRGSQSTVAVVVLARLQWSSTELAYFSLSACPDKGIVLCGDEEGNVWLYDVSNILKQPPLLPAALQAPTQILKWPQPWALGQVVTKTMVNTVVANASFTYLTALTDSNIVAIWGRM

SEQ ID NO: 45981 - protein, 41 aa, Homo sapiens
  Payload ID: 9397
  Gene Symbol: LRWD1
  Gene Name: leucine-rich repeats and WD repeat domain containing 1
  ENSP ID: ENSP00000417913
  MOD_RES (1)..(1): Any amino acid
XARLLMQRGRPKSDRLGKIRSLDGVESGVVARASSPSYSRG

SEQ ID NO: 45982 - protein, 45 aa, Homo sapiens
  Payload ID: 9397
  Gene Symbol: LRWD1
  Gene Name: leucine-rich repeats and WD repeat domain containing 1
  ENSP ID: ENSP00000418204
MGPLSARLLMQRGRPKSDRLGKIRSLDGVESGVVARASSPSYSRG

SEQ ID NO: 45983 - protein, 242 aa, Homo sapiens
  Payload ID: 9397
  Gene Symbol: LRWD1
  Gene Name: leucine-rich repeats and WD repeat domain containing 1
  ENSP ID: ENSP00000420373
  MOD_RES (1)..(1): Any amino acid
XRIILWDIGVPNQDYEFQASQLLTLDTTSIPLRLCPVASCPDARLLAGCEGGCCCWDVRLDQPQKRRVCEVEFVFSEGSEASGRRVDGLAFVNEDIVASKGSGLGTICLWSWRQTWGGRGSQSTVAVVVLARLQWSSTELAYFSLSACPDKGIVLCGDEEGNVWLYDVSNILKQPPLLPAALQAPTQPSPPLSPHQILKWPQPWALGQVVTKTMVNTVVANASFTYLTALTDSNIVAIWGRM

SEQ ID NO: 45984 - protein, 154 aa, Homo sapiens
  Payload ID: 9397
  Gene Symbol: LRWD1
  Gene Name: leucine-rich repeats and WD repeat domain containing 1
  ENSP ID: ENSP00000420650
MATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEE

SEQ ID NO: 45985 - protein, 179 aa, Homo sapiens
  Payload ID: 9397
  Gene Symbol: LRWD1
  Gene Name: leucine-rich repeats and WD repeat domain containing 1
  ENSP ID: ENSP00000420729
  MOD_RES (1)..(1): Any amino acid
XSLDLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRGWGHLGLCPAS

SEQ ID NO: 45986 - protein, 45 aa, Homo sapiens; identical to SEQ ID NO: 45982
  Payload ID: 9397
  Gene Symbol: LRWD1
  Gene Name: leucine-rich repeats and WD repeat domain containing 1
  ENSP ID: ENSP00000487494

SEQ ID NO: 45987 - protein, 131 aa, Homo sapiens
  Payload ID: 9398
  Gene Symbol: LSMEM1
  Gene Name: leucine-rich single-pass membrane protein 1
  Uniprot ID: Q8N8F7
  ENSP ID: ENSP00000323304
MTHSSQDTGSCGIQEDGKLYVVDSINDLNKLNLCPAGSQHLFPLEDKIPVLGTNSGNGSRSLFFVGLLIVLIVSLALVFFVIFLIVQTGNKMDDVSRRLTAEGKDIDDLKRINNMIVKRLNQLNQLDSEQN

SEQ ID NO: 45988 - protein, 131 aa, Homo sapiens; identical to SEQ ID NO: 45987
  Payload ID: 9398
  Gene Symbol: LSMEM1
  Gene Name: leucine-rich single-pass membrane protein 1
  Uniprot ID: Q8N8F7
  ENSP ID: ENSP00000389278

SEQ ID NO: 45989 - protein, 59 aa, Homo sapiens
  Payload ID: 9398
  Gene Symbol: LSMEM1
  Gene Name: leucine-rich single-pass membrane protein 1
  Uniprot ID: Q8N8F7
  ENSP ID: ENSP00000412823
MTHSSQDTGSCGIQEDGKLYVVDSINDLNKLNLCPAGSQHLFLLRQSSKNFPKRSKEIA

SEQ ID NO: 45990 - protein, 164 aa, Homo sapiens
  Payload ID: 9399
  Gene Symbol: LSMEM2
  Gene Name: leucine-rich single-pass membrane protein 2
  Uniprot ID: Q8N112
  ENSP ID: ENSP00000315081
MPSLAPDCPLLAMPEETQEDSVAPMMPSQRSRGPLAPNHVHEVCLHQVESISDLHSGAGTLRPYLTEEARPWDELLGVLPPSLCAQAGCSPVYRRGGFLLLLALLVLTCLVLALLAVYLSVLQSESLRILAHTLRTQEETLLKLRLASLSQLRRLNSSEAQAPS

SEQ ID NO: 45991 - protein, 291 aa, Homo sapiens
  Payload ID: 9400
  Gene Symbol: LGI1
  Gene Name: leucine-rich, glioma inactivated 1
  Uniprot ID: O95970
  ENSP ID: ENSP00000360467
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITVLREIHRFTNMS

SEQ ID NO: 45992 - protein, 557 aa, Homo sapiens
  Payload ID: 9400
  Gene Symbol: LGI1
  Gene Name: leucine-rich, glioma inactivated 1
  Uniprot ID: O95970
  ENSP ID: ENSP00000360472
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 45993 - protein, 72 aa, Homo sapiens
  Payload ID: 9400
  Gene Symbol: LGI1
  Gene Name: leucine-rich, glioma inactivated 1
  ENSP ID: ENSP00000485868
MESERSKRMGNACIPLKRIAYFLCLLSALLLTEGKKPAKPKCPAVCTCTKDNALCENARSIPRTVPPDVISL

SEQ ID NO: 45994 - protein, 509 aa, Homo sapiens
  Payload ID: 9400
  Gene Symbol: LGI1
  Gene Name: leucine-rich, glioma inactivated 1
  Uniprot ID: O95970
  ENSP ID: ENSP00000485917
MESERSKRMGNACIPLKRIAYFLCLLSALLLTEGKKPAKPKCPAVCTCTKDNALCENARSIPRTVPPDVISLSFVRSGFTEISEGSFLFTPSLQLLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 45995 - protein, 96 aa, Homo sapiens
  Payload ID: 9400
  Gene Symbol: LGI1
  Gene Name: leucine-rich, glioma inactivated 1
  ENSP ID: ENSP00000486517
MESERSKRMGNACIPLKRIAYFLCLLSALLLTEGKKPAKPKCPAVCTCTKDNALCENARSIPRTVPPDVISLSFVRSGFTEISEGSFLFTPSLQLL

SEQ ID NO: 45996 - protein, 168 aa, Homo sapiens
  Payload ID: 9400
  Gene Symbol: LGI1
  Gene Name: leucine-rich, glioma inactivated 1
  ENSP ID: ENSP00000486607
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNV

SEQ ID NO: 45997 - protein, 72 aa, Homo sapiens; identical to SEQ ID NO: 45993
  Payload ID: 9400
  Gene Symbol: LGI1
  Gene Name: leucine-rich, glioma inactivated 1
  ENSP ID: ENSP00000486859

SEQ ID NO: 45998 - protein, 533 aa, Homo sapiens
  Payload ID: 9400
  Gene Symbol: LGI1
  Gene Name: leucine-rich, glioma inactivated 1
  ENSP ID: ENSP00000486908
MESERSKRMGNACIPLKRIAYFLCLLSALLLTEGKKPAKPKCPAVCTCTKDNALCENARSIPRTVPPDVISLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 45999 - protein, 72 aa, Homo sapiens; identical to SEQ ID NO: 45993
  Payload ID: 9400
  Gene Symbol: LGI1
  Gene Name: leucine-rich, glioma inactivated 1
  ENSP ID: ENSP00000487116

SEQ ID NO: 46000 - protein, 840 aa, Homo sapiens
  Payload ID: 9401
  Gene Symbol: LZTR1
  Gene Name: leucine-zipper-like transcription regulator 1
  Uniprot ID: Q8N653
  ENSP ID: ENSP00000215739
MAGPGSTGGQIGAAALAGGARSKVAPSVDFDHSCSDSVEYLTLNFGPFETVHRWRRLPPCDEFVGARRSKHTVVAYKDAIYVFGGDNGKTMLNDLLRFDVKDCSWCRAFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNLFQFEFKDKTWTRIPTEHLLRGSPPPPQRRYGHTMVAFDRHLYVFGGAADNTLPNELHCYDVDFQTWEVVQPSSDSEVGGAEVPERACASEEVPTLTYEERVGFKKSRDVFGLDFGTTSAKQPTQPASELPSGRLFHAAAVISDAMYIFGGTVDNNIRSGEMYRFQFSCYPKCTLHEDYGRLWESRQFCDVEFVLGEKEECVQGHVAIVTARSRWLRRKITQARERLAQKLEQEAAPVPREAPGVAAGGARPPLLHVAIREAEARPFEVLMQFLYTDKIKYPRKGHVEDVLLIMDVYKLALSFQLCRLEQLCRQYIEASVDLQNVLVVCESAARLQLSQLKEHCLNFVVKESHFNQVIMMKEFERLSSPLIVEIVRRKQQPPPRTPLDQPVDIGTSLIQDMKAYLEGAGAEFCDITLLLDGHPRPAHKAILAARSSYFEAMFRSFMPEDGQVNISIGEMVPSRQAFESMLRYIYYGEVNMPPEDSLYLFAAPYYYGFYNNRLQAYCKQNLEMNVTVQNVLQILEAADKTQALDMKRHCLHIIVHQFTKVSKLPTLRSLSQQLLLDIIDSLASHISDKQCAELGADI

SEQ ID NO: 46001 - protein, 111 aa, Homo sapiens
  Payload ID: 9401
  Gene Symbol: LZTR1
  Gene Name: leucine-zipper-like transcription regulator 1
  ENSP ID: ENSP00000390836
  MOD_RES (1)..(1): Any amino acid
XVDLQNVLVVCESAARLQLSQLKEHCLNFVVKESHFNQVIMMKEFERLSSPLIVEIVRRKQQPPPRTPLDQPVDIGPFIPPALPGACADPGCWLLVMSAGTRGHAVGLEGA

SEQ ID NO: 46002 - protein, 97 aa, Homo sapiens
  Payload ID: 9401
  Gene Symbol: LZTR1
  Gene Name: leucine-zipper-like transcription regulator 1
  ENSP ID: ENSP00000393765
MQFLYTDKIKYPRKERAGCVRECRPAAAEPTQGALPELRGKGVPLQPGDHDEGVRAPLLSTDSGDCAAEAAAAPSHSLGPASGHWPLHSPSSPWGLC

SEQ ID NO: 46003 - protein, 117 aa, Homo sapiens
  Payload ID: 9401
  Gene Symbol: LZTR1
  Gene Name: leucine-zipper-like transcription regulator 1
  ENSP ID: ENSP00000397247
MAGPGSTGGQIGAAALAGGARSKVAPSVDFDHSCSDSVEYLTLNFGPFETVHRWRRLPPCDEFVGARRSKHTVVAYKDAIYVFGGDNGKTMLNDLLRFDVKDCSWCRGLHWGHLFQF

SEQ ID NO: 46004 - protein, 158 aa, Homo sapiens
  Payload ID: 9401
  Gene Symbol: LZTR1
  Gene Name: leucine-zipper-like transcription regulator 1
  ENSP ID: ENSP00000397252
  MOD_RES (1)..(1): Any amino acid
XEDGQVNISIGEMVPSRQAFESMLRYIYYGEVNMPPEDSLYLFAAPYYYGFYNNRLQAYCKQNLEMNVTVQNVLQILEAADKTQALDMKRHCLHIIVHQFTKVRALASPSGLASPWQWPCPGREGAQALWSPAVVGPGGERSRAAHHWPHLASSLGPA

SEQ ID NO: 46005 - protein, 101 aa, Homo sapiens
  Payload ID: 9401
  Gene Symbol: LZTR1
  Gene Name: leucine-zipper-like transcription regulator 1
  ENSP ID: ENSP00000406466
MAGPGSTGGQIGAAALAGGARSKVAPSVDFDHSCSDSVEYLTLNFGPFETVHRWRRLPPCDEFVGARYGAASTQWWPIKMPFMYLVETMGRPCSMTSCGSM

SEQ ID NO: 46006 - protein, 54 aa, Homo sapiens
  Payload ID: 9401
  Gene Symbol: LZTR1
  Gene Name: leucine-zipper-like transcription regulator 1
  ENSP ID: ENSP00000408789
FNQVIMMKEFERLSSPLIVEIVRRKQQPPPRTPLDQPVDIGHEGIPGGSGRGIL

SEQ ID NO: 46007 - protein, 1025 aa, Homo sapiens
  Payload ID: 9402
  Gene Symbol: LNPEP
  Gene Name: leucyl/cystinyl aminopeptidase
  Uniprot ID: Q9UIQ6
  ENSP ID: ENSP00000231368
MEPFTNDRLQLPRNMIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPEKIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 46008 - protein, 1011 aa, Homo sapiens
  Payload ID: 9402
  Gene Symbol: LNPEP
  Gene Name: leucyl/cystinyl aminopeptidase
  Uniprot ID: Q9UIQ6
  ENSP ID: ENSP00000379117
MIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPEKIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 46009 - protein, 485 aa, Homo sapiens
  Payload ID: 9403
  Gene Symbol: LARS
  Gene Name: leucyl-tRNA synthetase
  Uniprot ID: Q9P2J5
  ENSP ID: ENSP00000274562
MWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 46010 - protein, 1176 aa, Homo sapiens
  Payload ID: 9403
  Gene Symbol: LARS
  Gene Name: leucyl-tRNA synthetase
  Uniprot ID: Q9P2J5
  ENSP ID: ENSP00000377954
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 46011 - protein, 1122 aa, Homo sapiens
  Payload ID: 9403
  Gene Symbol: LARS
  Gene Name: leucyl-tRNA synthetase
  Uniprot ID: Q9P2J5
  ENSP ID: ENSP00000426005
MNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 46012 - protein, 160 aa, Homo sapiens
  Payload ID: 9403
  Gene Symbol: LARS
  Gene Name: leucyl-tRNA synthetase
  ENSP ID: ENSP00000481381
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAALKLDLLNTSGAL

SEQ ID NO: 46013 - protein, 903 aa, Homo sapiens
  Payload ID: 9404
  Gene Symbol: LARS2
  Gene Name: leucyl-tRNA synthetase 2, mitochondrial
  Uniprot ID: Q15031
  ENSP ID: ENSP00000265537
MASVWQRLGFYASLLKRQLNGGPDVIKWERRVIPGCTRSIYSATGKWTKEYTLQTRKDVEKWWHQRIKEQASKISEADKSKPKFYVLSMFPYPSGKLHMGHVRVYTISDTIARFQKMRGMQVINPMGWDAFGLPAENAAVERNLHPQSWTQSNIKHMRKQLDRLGLCFSWDREITTCLPDYYKWTQYLFIKLYEAGLAYQKEALVNWDPVDQTVLANEQVDEHGCSWRSGAKVEQKYLRQWFIKTTAYAKAMQDALADLPEWYGIKGMQAHWIGDCVGCHLDFTLKVHGQATGEKLTAYTATPEAIYGTSHVAISPSHRLLHGHSSLKEALRMALVPGKDCLTPVMAVNMLTQQEVPVVILAKADLEGSLDSKIGIPSTSSEDTILAQTLGLAYSEVIETLPDGTERLSSSAEFTGMTRQDAFLALTQKARGKRVGGDVTSDKLKDWLISRQRYWGTPIPIVHCPVCGPTPVPLEDLPVTLPNIASFTGKGGPPLAMASEWVNCSCPRCKGAAKRETDTMDTFVDSAWYYFRYTDPHNPHSPFNTAVADYWMPVDLYIGGKEHAVMHLFYARFFSHFCHDQKMVKHREPFHKLLAQGLIKGQTFRLPSGQYLQREEVDLTGSVPVHAKTKEKLEVTWEKMSKSKHNGVDPEEVVEQYGIDTIRLYILFAAPPEKDILWDVKTDALPGVLRWQQRLWTLTTRFIEARASGKSPQPQLLSNKEKAEARKLWEYKNSVISQVTTHFTEDFSLNSAISQLMGLSNALSQASQSVILHSPEFEDALCALMVMAAPLAPHVTSEIWAGLALVPRKLCAHYTWDASVLLQAWPAVDPEFLQQPEVVQMAVLINNKACGKIPVPQQVARDQDKVHEFVLQSELGVRLLQGRSIKKSFLSPRTALINFLVQD

SEQ ID NO: 46014 - protein, 114 aa, Homo sapiens
  Payload ID: 9404
  Gene Symbol: LARS2
  Gene Name: leucyl-tRNA synthetase 2, mitochondrial
  ENSP ID: ENSP00000401388
MASVWQRLGFYASLLKRQLNGGPDVIKWERRVIPGCTRSIYSATGKWTKEYTLQTRKDVEKWWHQRIKEQASKISEADKSKPKFYVLSMFPYPSGKLHMGHVRVYTISDTIARF

SEQ ID NO: 46015 - protein, 144 aa, Homo sapiens
  Payload ID: 9404
  Gene Symbol: LARS2
  Gene Name: leucyl-tRNA synthetase 2, mitochondrial
  ENSP ID: ENSP00000406611
MASVWQRLGFYASLLKRQLNGGPDVIKWERRVIPGCTRSIYSATGKWTKEYTLQTRKDVEKWWHQRIKEQASKISEADVINPMGWDAFGLPAENAAVERNLHPQSWTQSNIKHMRKQLDRLGLCFSWDREITTCLPDYYKWTQY

SEQ ID NO: 46016 - protein, 903 aa, Homo sapiens; identical to SEQ ID NO: 46013
  Payload ID: 9404
  Gene Symbol: LARS2
  Gene Name: leucyl-tRNA synthetase 2, mitochondrial
  Uniprot ID: Q15031
  ENSP ID: ENSP00000408576

SEQ ID NO: 46017 - protein, 860 aa, Homo sapiens
  Payload ID: 9404
  Gene Symbol: LARS2
  Gene Name: leucyl-tRNA synthetase 2, mitochondrial
  ENSP ID: ENSP00000412893
MASVWQRLGFYASLLKRQLNGGPDVIKWERRVIPGCTRSIYSATGKWTKEYTLQTRKDVEKWWHQRIKEQASKISEADVINPMGWDAFGLPAENAAVERNLHPQSWTQSNIKHMRKQLDRLGLCFSWDREITTCLPDYYKWTQYLFIKLYEAGLAYQKEALVNWDPVDQTVLANEQVDEHGCSWRSGAKVEQKYLRQWFIKTTAYAKAMQDALADLPEWYGIKGMQAHWIGDCVGCHLDFTLKVHGQATGEKLTAYTATPEAIYGTSHVAISPSHRLLHGHSSLKEALRMALVPGKDCLTPVMAVNMLTQQEVPVVILAKADLEGSLDSKIGIPSTSSEDTILAQTLGLAYSEVIETLPDGTERLSSSAEFTGMTRQDAFLALTQKARGKRVGGDVTSDKLKDWLISRQRYWGTPIPIVHCPVCGPTPVPLEDLPVTLPNIASFTGKGGPPLAMASEWVNCSCPRCKGAAKRETDTMDTFVDSAWYYFRYTDPHNPHSPFNTAVADYWMPVDLYIGGKEHAVMHLFYARFFSHFCHDQKMVKHREPFHKLLAQGLIKGQTFRLPSGQYLQREEVDLTGSVPVHAKTKEKLEVTWEKMSKSKHNGVDPEEVVEQYGIDTIRLYILFAAPPEKDILWDVKTDALPGVLRWQQRLWTLTTRFIEARASGKSPQPQLLSNKEKAEARKLWEYKNSVISQVTTHFTEDFSLNSAISQLMGLSNALSQASQSVILHSPEFEDALCALMVMAAPLAPHVTSEIWAGLALVPRKLCAHYTWDASVLLQAWPAVDPEFLQQPEVVQMAVLINNKACGKIPVPQQVARDQDKVHEFVLQSELGVRLLQGRSIKKSFLSPRTALINFLVQD

SEQ ID NO: 46018 - protein, 202 aa, Homo sapiens
  Payload ID: 9405
  Gene Symbol: LIF
  Gene Name: leukemia inhibitory factor
  Uniprot ID: P15018
  ENSP ID: ENSP00000249075
MKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 46019 - protein, 88 aa, Homo sapiens
  Payload ID: 9405
  Gene Symbol: LIF
  Gene Name: leukemia inhibitory factor
  Uniprot ID: P15018
  ENSP ID: ENSP00000384450
MKVLAAVHSPGGAVPQQPGQAMWPQRDGLPALPRQRHGEGQAGGAVPHSRVPWHLPGQHHPGPEDPQPQCPQPPQQAQRHRRHPARPP

SEQ ID NO: 46020 - protein, 1097 aa, Homo sapiens
  Payload ID: 9406
  Gene Symbol: LIFR
  Gene Name: leukemia inhibitory factor receptor alpha
  Uniprot ID: P42702
  ENSP ID: ENSP00000263409
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCYRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 46021 - protein, 1097 aa, Homo sapiens; identical to SEQ ID NO: 46020
  Payload ID: 9406
  Gene Symbol: LIFR
  Gene Name: leukemia inhibitory factor receptor alpha
  Uniprot ID: P42702
  ENSP ID: ENSP00000398368

SEQ ID NO: 46022 - protein, 125 aa, Homo sapiens
  Payload ID: 9406
  Gene Symbol: LIFR
  Gene Name: leukemia inhibitory factor receptor alpha
  ENSP ID: ENSP00000426685
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKF

SEQ ID NO: 46023 - protein, 66 aa, Homo sapiens
  Payload ID: 9406
  Gene Symbol: LIFR
  Gene Name: leukemia inhibitory factor receptor alpha
  ENSP ID: ENSP00000426919
  MOD_RES (1)..(1): Any amino acid
XWSNKKQHLTTEASPSKGPDTWREWSSDGKNLIIYWKMRKHSPFLKSLILSTKQRYDLIRMTTSSA

SEQ ID NO: 46024 - protein, 74 aa, Homo sapiens
  Payload ID: 9406
  Gene Symbol: LIFR
  Gene Name: leukemia inhibitory factor receptor alpha
  ENSP ID: ENSP00000427310
MMDIYVCLKRPSWMVDNKRMRTASNFQWLLSTFILLYLMNQVNSQKKGAPHDLKCVTNNLQVWNCSWKAPSGTG

SEQ ID NO: 46025 - protein, 178 aa, Homo sapiens
  Payload ID: 9407
  Gene Symbol: LNP1
  Gene Name: leukemia NUP98 fusion partner 1
  Uniprot ID: A1A4G5
  ENSP ID: ENSP00000373191
MEHKDDDDDDVSFAKWMSSFWGHSWREEDQRGLRERHRLQATSHRKTSLPCPLPVLPRIPSSDCHPRRHSHEDQEFRCRSHVRDYRKYSEDGSFKEPLESKGRSHSKIEKFSESFERQLCFRTKRSASLGPESRKERNERECLRMEIKSRKKVEEERSSRKEEHGEAHMAPLFEKGPE

SEQ ID NO: 46026 - protein, 191 aa, Homo sapiens
  Payload ID: 9407
  Gene Symbol: LNP1
  Gene Name: leukemia NUP98 fusion partner 1
  ENSP ID: ENSP00000417985
MEHKDDDDDDVSFAKWMSSFWGHSWREEDQRGLRERHRLQATSHRKTSLPCPSFYTVNFFILYSQLPVLPRIPSSDCHPRRHSHEDQEFRCRSHVRDYRKYSEDGSFKEPLESKGRSHSKIEKFSESFERQLCFRTKRSASLGPESRKERNERECLRMEIKSRKKVEEERSSRKEEHGEAHMAPLFEKGPE

SEQ ID NO: 46027 - protein, 56 aa, Homo sapiens
  Payload ID: 9407
  Gene Symbol: LNP1
  Gene Name: leukemia NUP98 fusion partner 1
  ENSP ID: ENSP00000419213
MEHKDDDDDDVSFAKWMSSFWGHSWREEDQRGLRERHRLQATSHRKTSLPCPNSII

SEQ ID NO: 46028 - protein, 334 aa, Homo sapiens
  Payload ID: 9408
  Gene Symbol: LECT1
  Gene Name: leukocyte cell derived chemotaxin 1
  Uniprot ID: O75829
  ENSP ID: ENSP00000367198
MTENSDKVPIALVGPDDVEFCSPPAYATLTVKPSSPARLLKVGAVVLISGAVLLLFGAIGAFYFWKGSDSHIYNVHYTMSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPKEIQRERREVVRKIVPTTTKRPHSGPRSNPGAGRLNNETRPSVQEDSQAFNPDNPYHQQEGESMTFDPRLDHEGICCIECRRSYTHCQKICEPLGGYYPWPYNYQGCRSACRVIMPCSWWVARILGMV

SEQ ID NO: 46029 - protein, 333 aa, Homo sapiens
  Payload ID: 9408
  Gene Symbol: LECT1
  Gene Name: leukocyte cell derived chemotaxin 1
  Uniprot ID: O75829
  ENSP ID: ENSP00000388576
MTENSDKVPIALVGPDDVEFCSPPAYATLTVKPSSPARLLKVGAVVLISGAVLLLFGAIGAFYFWKGSDSHIYNVHYTMSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPKEIQRERREVVRKIVPTTTKRPHSGPRSNPGAGRLNNETRPSVQEDSQAFNPDNPYHQEGESMTFDPRLDHEGICCIECRRSYTHCQKICEPLGGYYPWPYNYQGCRSACRVIMPCSWWVARILGMV

SEQ ID NO: 46030 - protein, 129 aa, Homo sapiens
  Payload ID: 9408
  Gene Symbol: LECT1
  Gene Name: leukocyte cell derived chemotaxin 1
  ENSP ID: ENSP00000396035
MSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPK

SEQ ID NO: 46031 - protein, 151 aa, Homo sapiens
  Payload ID: 9409
  Gene Symbol: LECT2
  Gene Name: leukocyte cell-derived chemotaxin 2
  Uniprot ID: O14960
  ENSP ID: ENSP00000274507
MFSTKALLLAGLISTALAGPWANICAGKSSNEIRTCDRHGCGQYSAQRSQRPHQGVDILCSAGSTVYAPFTGMIVGQEKPYQNKNAINNGVRISGRGFCVKMFYIKPIKYKGPIKKGEKLGTLLPLQKVYPGIQSHVHIENCDSSDPTAYL

SEQ ID NO: 46032 - protein, 111 aa, Homo sapiens
  Payload ID: 9409
  Gene Symbol: LECT2
  Gene Name: leukocyte cell-derived chemotaxin 2
  ENSP ID: ENSP00000421123
MFSTKALLLAGLISTALAGPWANICAGKSSNEIRTCDRHGCGQYSAQRSQRPHQGVDILCSAGSTVYAPFTGMIVGQEKPYQNKNAINNGVRISGRGKRGGVYTWGASWRC

SEQ ID NO: 46033 - protein, 79 aa, Homo sapiens
  Payload ID: 9409
  Gene Symbol: LECT2
  Gene Name: leukocyte cell-derived chemotaxin 2
  ENSP ID: ENSP00000427012
MIVGQEKPYQNKNAINNGVRISGRGFCVKMFYIKPIKYKGPIKKGEKLGTLLPLQKVYPGIQSHVHIENCDSSDPTAYL

SEQ ID NO: 46034 - protein, 131 aa, Homo sapiens
  Payload ID: 9409
  Gene Symbol: LECT2
  Gene Name: leukocyte cell-derived chemotaxin 2
  ENSP ID: ENSP00000429618
MFSTKALLLAGLISTALAGPWANICAGKSSNEIRTCDRHGCGQYSAQRSQRPHQGVDILCSAGSTVYAPFTGMIVGQEKPYQNKNAINNGVRISGREITTDTPIFNNYYPDQSAAVNIKTRSSTSKKMMTH

SEQ ID NO: 46035 - protein, 489 aa, Homo sapiens
  Payload ID: 9410
  Gene Symbol: LILRA1
  Gene Name: leukocyte immunoglobulin-like receptor, subfamily A (with TM domain), member 1
  Uniprot ID: O75019
  ENSP ID: ENSP00000251372
MTPIVTVLICLRLSLGPRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGVSKKPSLSVQPGPIVAPGESLTLQCVSDVSYDRFVLYKEGERDFLQLPGPQPQAGLSQANFTLGPVSRSYGGQYRCSGAYNLSSEWSAPSDPLDILIAGQFRGRPFISVHPGPTVASGENVTLLCQSWGPFHTFLLTKAGAADAPLRLRSIHEYPKYQAEFPMSPVTSAHSGTYRCYGSLSSNPYLLSHPSDSLELMVSGAAETLSPPQNKSDSKAGAANTLSPSQNKTASHPQDYTVENLIRMGIAGLVLVVLGILLFEAQHSQRSL

SEQ ID NO: 46036 - protein, 289 aa, Homo sapiens
  Payload ID: 9410
  Gene Symbol: LILRA1
  Gene Name: leukocyte immunoglobulin-like receptor, subfamily A (with TM domain), member 1
  Uniprot ID: O75019
  ENSP ID: ENSP00000413715
MTPIVTVLICLRLSLGPRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGAAETLSPPQNKSDSKAGAANTLSPSQNKTASHPQDYTVENLIRMGIAGLVLVVLGILLFEAQHSQRSL

SEQ ID NO: 46037 - protein, 489 aa, Homo sapiens; identical to SEQ ID NO: 46035
  Payload ID: 9410
  Gene Symbol: LILRA1
  Gene Name: leukocyte immunoglobulin-like receptor, subfamily A (with TM domain), member 1
  Uniprot ID: O75019
  ENSP ID: ENSP00000477637

SEQ ID NO: 46038 - protein, 289 aa, Homo sapiens; identical to SEQ ID NO: 46036
  Payload ID: 9410
  Gene Symbol: LILRA1
  Gene Name: leukocyte immunoglobulin-like receptor, subfamily A (with TM domain), member 1
  Uniprot ID: O75019
  ENSP ID: ENSP00000478666

SEQ ID NO: 46039 - protein, 439 aa, Homo sapiens
  Payload ID: 9410
  Gene Symbol: LILRA1
  Gene Name: leukocyte immunoglobulin-like receptor, subfamily A (with TM domain), member 1
  ENSP ID: ENSP00000479343
MTPILTVLICLGLSLGPRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGVSKKPSLSVQPGPIVAPGESLTLQCVSDVSYDRFVLYKEGERDFLQLPGPQPQAGLSQANFTLGPVSRSYGGQYRCSGAYNLSSEWSAPSDPLDILIAGQFRGRPFISVHPGPTVASGENVTLLCQSWGPFHTFLLTKAGAADAPLRLRSIHEYPKYQAEFPMSPVTSAHSGTYRCYGSLSSNPYLLSHPSDSLELMVSGAAETLSPPQNKSDSKAGE

SEQ ID NO: 46040 - protein, 439 aa, Homo sapiens; identical to SEQ ID NO: 46039
  Payload ID: 9410
  Gene Symbol: LILRA1
  Gene Name: leukocyte immunoglobulin-like receptor, subfamily A (with TM domain), member 1
  ENSP ID: ENSP00000479482

SEQ ID NO: 46041 - protein, 506 aa, Homo sapiens
  Payload ID: 9410
  Gene Symbol: LILRA1
  Gene Name: leukocyte immunoglobulin-like receptor, subfamily A (with TM domain), member 1
  ENSP ID: ENSP00000480299
MHRGLIHPQSRAVGGDAMTPIVTVLICLRLSLGPRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGVSKKPSLSVQPGPIVAPGESLTLQCVSDVSYDRFVLYKEGERDFLQLPGPQPQAGLSQANFTLGPVSRSYGGQYRCSGAYNLSSEWSAPSDPLDILIAGQFRGRPFISVHPGPTVASGENVTLLCQSWGPFHTFLLTKAGAADAPLRLRSIHEYPKYQAEFPMSPVTSAHSGTYRCYGSLSSNPYLLSHPSDSLELMVSGAAETLSPPQNKSDSKAGAANTLSPSQNKTASHPQDYTVENLIRMGIAGLVLVVLGILLFEAQHSQRSL

SEQ ID NO: 46042 - protein, 439 aa, Homo sapiens; identical to SEQ ID NO: 46039
  Payload ID: 9410
  Gene Symbol: LILRA1
  Gene Name: leukocyte immunoglobulin-like receptor, subfamily A (with TM domain), member 1
  ENSP ID: ENSP00000481162

SEQ ID NO: 46043 - protein, 506 aa, Homo sapiens; identical to SEQ ID NO: 46041
  Payload ID: 9410
  Gene Symbol: LILRA1
  Gene Name: leukocyte immunoglobulin-like receptor, subfamily A (with TM domain), member 1
  ENSP ID: ENSP00000483224

SEQ ID NO: 46044 - protein, 439 aa, Homo sapiens; identical to SEQ ID NO: 46039
  Payload ID: 9410
  Gene Symbol: LILRA1
  Gene Name: leukocyte immunoglobulin-like receptor, subfamily A (with TM domain), member 1
  ENSP ID: ENSP00000484160

SEQ ID NO: 46045 - protein, 289 aa, Homo sapiens; identical to SEQ ID NO: 46036
  Payload ID: 9410
  Gene Symbol: LILRA1
  Gene Name: leukocyte immunoglobulin-like receptor, subfamily A (with TM domain), member 1
  Uniprot ID: O75019
  ENSP ID: ENSP00000487011

SEQ ID NO: 46046 - protein, 289 aa, Homo sapiens; identical to SEQ ID NO: 46036
  Payload ID: 9410
  Gene Symbol: LILRA1
  Gene Name: leukocyte immunoglobulin-like receptor, subfamily A (with TM domain), member 1
  Uniprot ID: O75019
  ENSP ID: ENSP00000487229

SEQ ID NO: 46047 - protein, 466 aa, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENSP ID: ENSP00000251376
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTSGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 46048 - protein, 483 aa, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENSP ID: ENSP00000251377
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTSGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSEAAETLSPSQNKTDSTTTSLGQHPQDYTVENLIRMGVAGLVLVVLGILLFEAQHSQRSLQDAAGR

SEQ ID NO: 46049 - protein, 454 aa, Homo sapiens
  Payload ID: 9411
  Gene Symbol: LILRA2
  Gene Name: leukocyte immunoglobulin-like receptor, subfamily A (with TM domain), member 2
  ENSP ID: ENSP00000375617
MTPILTVLICLGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTSGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 46050 - protein, 483 aa, Homo sapiens; identical to SEQ ID NO: 46048
  Payload ID: 9411
  Gene Symbol: LILRA2
  Gene Name: leukocyte immunoglobulin-like receptor, subfamily A (with TM domain), member 2
  Uniprot ID: Q8N149
  ENSP ID: ENSP00000375618

SEQ ID NO: 46051 - protein, 327 aa, Homo sapiens
  Payload ID: 9411
  Gene Symbol: LILRA2
  Gene Name: leukocyte immunoglobulin-like receptor, subfamily A (with TM domain), member 2
  ENSP ID: ENSP00000388131
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTSGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLS

SEQ ID NO: 46052 - protein, 85 aa, Homo sapiens
  Payload ID: 9411
  Gene Symbol: LILRA2
  Gene Name: leukocyte immunoglobulin-like receptor, subfamily A (with TM domain), member 2
  ENSP ID: ENSP00000477566
  MOD_RES (1)..(1): Any amino acid
XSLPSDPLELVVSEPLSISPSPTPAGSLGHLKTREEAAWASVGSDCDEAGVHPRCAPLERSTPAVGAAHTAPPVLTWRPLCSGHP

SEQ ID NO: 46053 - protein, 490 aa, Homo sapiens
  Payload ID: 9411
  Gene Symbol: LILRA2
  Gene Name: leukocyte immunoglobulin-like receptor, subfamily A (with TM domain), member 2
  ENSP ID: ENSP00000477712
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSEPLSISPSPTPAGSLGHLKTREEAAWASVGSDCDEAGVHPRCAPLERSTPAVGAAHTAPPVLTWRPLCSGHP

SEQ ID NO: 46054 - protein, 483 aa, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENSP ID: ENSP00000478981
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSEAAETLSPSQNKTDSTTTSLGQHPQDYTVENLIRMGVAGLVLVVLGILLFEAQHSQRSLQDAAGR

SEQ ID NO: 46055 - protein, 490 aa, Homo sapiens; identical to SEQ ID NO: 46053
  Payload ID: 9411
  Gene Symbol: LILRA2
  Gene Name: leukocyte immunoglobulin-like receptor, subfamily A (with TM domain), member 2
  ENSP ID: ENSP00000478991

SEQ ID NO: 46056 - protein, 466 aa, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENSP ID: ENSP00000479743
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 46057 - protein, 454 aa, Homo sapiens
  Payload ID: 9411
  Gene Symbol: LILRA2
  Gene Name: leukocyte immunoglobulin-like receptor, subfamily A (with TM domain), member 2
  ENSP ID: ENSP00000479769
MTPILTVLICLGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 46058 - protein, 327 aa, Homo sapiens
  Payload ID: 9411
  Gene Symbol: LILRA2
  Gene Name: leukocyte immunoglobulin-like receptor, subfamily A (with TM domain), member 2
  ENSP ID: ENSP00000479801
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLS

SEQ ID NO: 46059 - protein, 483 aa, Homo sapiens; identical to SEQ ID NO: 46054
  Payload ID: 9411
  Gene Symbol: LILRA2
  Gene Name: leukocyte immunoglobulin-like receptor, subfamily A (with TM domain), member 2
  Uniprot ID: Q8N149
  ENSP ID: ENSP00000479914

SEQ ID NO: 46060 - protein, 454 aa, Homo sapiens; identical to SEQ ID NO: 46057
  Payload ID: 9411
  Gene Symbol: LILRA2
  Gene Name: leukocyte immunoglobulin-like receptor, subfamily A (with TM domain), member 2
  ENSP ID: ENSP00000480179

SEQ ID NO: 46061 - protein, 85 aa, Homo sapiens; identical to SEQ ID NO: 46052
  Payload ID: 9411
  Gene Symbol: LILRA2
  Gene Name: leukocyte immunoglobulin-like receptor, subfamily A (with TM domain), member 2
  ENSP ID: ENSP00000480320
  MOD_RES (1)..(1): Any amino acid

SEQ ID NO: 46062 - protein, 466 aa, Homo sapiens; identical to SEQ ID NO: 46056
  Payload ID: 9411
  Gene Symbol: LILRA2
  Gene Name: leukocyte immunoglobulin-like receptor, subfamily A (with TM domain), member 2
  Uniprot ID: Q8N149
  ENSP ID: ENSP00000480939

SEQ ID NO: 46063 - protein, 483 aa, Homo sapiens; identical to SEQ ID NO: 46054
  Payload ID: 9411
  Gene Symbol: LILRA2
  Gene Name: leukocyte immunoglobulin-like receptor, subfamily A (with TM domain), member 2
  Uniprot ID: Q8N149
  ENSP ID: ENSP00000481338

SEQ ID NO: 46064 - protein, 483 aa, Homo sapiens; identical to SEQ ID NO: 46054
  Payload ID: 9411
  Gene Symbol: LILRA2
  Gene Name: leukocyte immunoglobulin-like receptor, subfamily A (with TM domain), member 2
  Uniprot ID: Q8N149
  ENSP ID: ENSP00000483906

SEQ ID NO: 46065 - protein, 466 aa, Homo sapiens; identical to SEQ ID NO: 46056
  Payload ID: 9411
  Gene Symbol: LILRA2
  Gene Name: leukocyte immunoglobulin-like receptor, subfamily A (with TM domain), member 2
  Uniprot ID: Q8N149
  ENSP ID: ENSP00000484762

SEQ ID NO: 46066 - protein, 203 aa, Homo sapiens
  Payload ID: 9411
  Gene Symbol: LILRA2
  Gene Name: leukocyte immunoglobulin-like receptor, subfamily A (with TM domain), member 2
  ENSP ID: ENSP00000485801
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 46067 - protein, 203 aa, Homo sapiens; identical to SEQ ID NO: 46066
  Payload ID: 9411
  Gene Symbol: LILRA2
  Gene Name: leukocyte immunoglobulin-like receptor, subfamily A (with TM domain), member 2
  ENSP ID: ENSP00000486317

SEQ ID NO: 46068 - protein, 203 aa, Homo sapiens; identical to SEQ ID NO: 46066
  Payload ID: 9411
  Gene Symbol: LILRA2
  Gene Name: leukocyte immunoglobulin-like receptor, subfamily A (with TM domain), member 2
  ENSP ID: ENSP00000486483

SEQ ID NO: 46069 - protein, 454 aa, Homo sapiens; identical to SEQ ID NO: 46057
  Payload ID: 9411
  Gene Symbol: LILRA2
  Gene Name: leukocyte immunoglobulin-like receptor, subfamily A (with TM domain), member 2
  ENSP ID: ENSP00000487398

SEQ ID NO: 46070 - protein, 203 aa, Homo sapiens; identical to SEQ ID NO: 46066
  Payload ID: 9411
  Gene Symbol: LILRA2
  Gene Name: leukocyte immunoglobulin-like receptor, subfamily A (with TM domain), member 2
  ENSP ID: ENSP00000487511

SEQ ID NO: 46071 - protein, 499 aa, Homo sapiens
  Payload ID: 9412
  Gene Symbol: LILRA4
  Gene Name: leukocyte immunoglobulin-like receptor, subfamily A (with TM domain), member 4
  Uniprot ID: P59901
  ENSP ID: ENSP00000291759
MTLILTSLLFFGLSLGPRTRVQAENLLKPILWAEPGPVITWHNPVTIWCQGTLEAQGYRLDKEGNSMSRHILKTLESENKVKLSIPSMMWEHAGRYHCYYQSPAGWSEPSDPLELVVTAYSRPTLSALPSPVVTSGVNVTLRCASRLGLGRFTLIEEGDHRLSWTLNSHQHNHGKFQALFPMGPLTFSNRGTFRCYGYENNTPYVWSEPSDPLQLLVSGVSRKPSLLTLQGPVVTPGENLTLQCGSDVGYIRYTLYKEGADGLPQRPGRQPQAGLSQANFTLSPVSRSYGGQYRCYGAHNVSSEWSAPSDPLDILIAGQISDRPSLSVQPGPTVTSGEKVTLLCQSWDPMFTFLLTKEGAAHPPLRLRSMYGAHKYQAEFPMSPVTSAHAGTYRCYGSRSSNPYLLSHPSEPLELVVSGATETLNPAQKKSDSKTAPHLQDYTVENLIRMGVAGLVLLFLGILLFEAQHSQRSPPRCSQEANSRKDNAPFRVVEPWEQI

SEQ ID NO: 46072 - protein, 140 aa, Homo sapiens
  Payload ID: 9412
  Gene Symbol: LILRA4
  Gene Name: leukocyte immunoglobulin-like receptor, subfamily A (with TM domain), member 4
  ENSP ID: ENSP00000471722
SSEWSAPSDPLDILIAGQISDRPSLSVQPGPTVTSGEKVTLLCQSWDPMFTFLLTKEGAAHPPLRLRSMYGAHKYQAEFPMSPVTSAHAGTYRCYGSRSSNPYLLSHPSEPLELVVSGEGADPVHSELKGVLGNEKGELP

SEQ ID NO: 46073 - protein, 499 aa, Homo sapiens
  Payload ID: 9412
  Gene Symbol: LILRA4
  Gene Name: leukocyte immunoglobulin-like receptor, subfamily A (with TM domain), member 4
  Uniprot ID: P59901
  ENSP ID: ENSP00000479979
MTLILTSLLFFGLSLGPRTRVQAENLPKPILWAEPGPVITWHNPVTIWCQGTLEAQGYRLDKEGNSMSRHILKTLESENKVKLSIPSMMWEHAGRYHCYYQSPAGWSEPSDPLELVVTAYSRPTLSALPSPVVTSGVNVTLRCASRLGLGRFTLIEEGDHRLSWTLNSHQHNHGKFQALFPMGPLTFSNRGTFRCYGYENNTPYVWSEPSDPLQLLVSGVSRKPSLLTLQGPVVTPGENLTLQCGSDVGYIRYTLYKEGADGLPQRPGRQPQAGLSQANFTLSPVSRSYGGQYRCYGAHNVSSEWSAPSDPLDILIAGQISDRPSLSVQPGPTVTSGEKVTLLCQSWDPMFTFLLTKEGAAHPPLRLRSMYGAHKYQAEFPMSPVTSAHAGTYRCYGSRSSNPYLLSHPSEPLELVVSGATETLNPAQKKSDSKTAPHLQDYTVENLIRMGVAGLVLLFLGILLFEAQHSQRSPPRCSQEANSRKDNAPFRVVEPWEQI

SEQ ID NO: 46074 - protein, 499 aa, Homo sapiens; identical to SEQ ID NO: 46073
  Payload ID: 9412
  Gene Symbol: LILRA4
  Gene Name: leukocyte immunoglobulin-like receptor, subfamily A (with TM domain), member 4
  Uniprot ID: P59901
  ENSP ID: ENSP00000481073

SEQ ID NO: 46075 - protein, 400 aa, Homo sapiens
  Payload ID: 9412
  Gene Symbol: LILRA4
  Gene Name: leukocyte immunoglobulin-like receptor, subfamily A (with TM domain), member 4
  ENSP ID: ENSP00000481298
MTLILTSLLFFGLSLGPRTRVQAENLPKPILWAEPGPVITWHNPVTIWCQGTLEAQGYRLDKEGNSMSRHILKTLESENKVKLSIPSMMWEHAGRYHCYYQSPAGWSEPSDPLELVVTAYSRPTLSALPSPVVTSGVNVTLRCASRLGLGRFTLIEEGDHRLSWTLNSHQHNHGKFQALFPMGPLTFSNRGTFRCYGYENNTPYVWSEPSDPLQLLVSGQISDRPSLSVQPGPTVTSGEKVTLLCQSWDPMFTFLLTKEGAAHPPLRLRSMYGAHKYQAEFPMSPVTSAHAGTYRCYGSRSSNPYLLSHPSEPLELVVSGATETLNPAQKKSDSKTAPHLQDYTVENLIRMGVAGLVLLFLGILLFEAQHSQRSPPRCSQEANSRKDNAPFRVVEPWEQI

SEQ ID NO: 46076 - protein, 499 aa, Homo sapiens; identical to SEQ ID NO: 46073
  Payload ID: 9412
  Gene Symbol: LILRA4
  Gene Name: leukocyte immunoglobulin-like receptor, subfamily A (with TM domain), member 4
  Uniprot ID: P59901
  ENSP ID: ENSP00000483846

SEQ ID NO: 46077 - protein, 299 aa, Homo sapiens
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000404236
MAPWSHPSAQLQPVGGDAVSPALMVLLCLGLSLGPRTHVQAGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGAADNLSPSQNKSDSGTASHLQDYAVENLIRMGMAGLILVVLGILIFQDWHSQRSPQAAAGR

SEQ ID NO: 46078 - protein, 265 aa, Homo sapiens
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000477785
MAPWSHPSAQLQPVGGDAVSPALMVLLCLGLSLGPRTHVQAGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGEEATVFSSTIQGSQTGCGELYRQGSPC

SEQ ID NO: 46079 - protein, 299 aa, Homo sapiens; identical to SEQ ID NO: 46077
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000478354

SEQ ID NO: 46080 - protein, 287 aa, Homo sapiens
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000480204
MAPWSHPSAQLQPVGGDAVSPALMVLLCLGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGAADNLSPSQNKSDSGTASHLQDYAVENLIRMGMAGLILVVLGILIFQDWHSQRSPQAAAGR

SEQ ID NO: 46081 - protein, 253 aa, Homo sapiens
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000480382
MAPWSHPSAQLQPVGGDAVSPALMVLLCLGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGEEATVFSSTIQGSQTGCGELYRQGSPC

SEQ ID NO: 46082 - protein, 253 aa, Homo sapiens; identical to SEQ ID NO: 46081
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000480436

SEQ ID NO: 46083 - protein, 299 aa, Homo sapiens; identical to SEQ ID NO: 46077
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000480458

SEQ ID NO: 46084 - protein, 287 aa, Homo sapiens; identical to SEQ ID NO: 46080
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000482658

SEQ ID NO: 46085 - protein, 299 aa, Homo sapiens; identical to SEQ ID NO: 46077
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000482882

SEQ ID NO: 46086 - protein, 265 aa, Homo sapiens; identical to SEQ ID NO: 46078
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000483958

SEQ ID NO: 46087 - protein, 287 aa, Homo sapiens; identical to SEQ ID NO: 46080
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000483992

SEQ ID NO: 46088 - protein, 253 aa, Homo sapiens; identical to SEQ ID NO: 46081
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000484062

SEQ ID NO: 46089 - protein, 287 aa, Homo sapiens; identical to SEQ ID NO: 46080
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000484372

SEQ ID NO: 46090 - protein, 265 aa, Homo sapiens; identical to SEQ ID NO: 46078
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000484775

SEQ ID NO: 46091 - protein, 299 aa, Homo sapiens; identical to SEQ ID NO: 46077
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000484785

SEQ ID NO: 46092 - protein, 287 aa, Homo sapiens; identical to SEQ ID NO: 46080
  Payload ID: 9413
  Gene Symbol: LILRA5
  Gene Name: leukocyte immunoglobulin-like receptor, subfamily A (with TM domain), member 5
  Uniprot ID: A6NI73
  ENSP ID: ENSP00000484869

SEQ ID NO: 46093 - protein, 464 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000245621
MTPTLAALLCLGLSLGPRTHVQAGPFPKPTLWAEPGSVISWGSPVTIWCQGSLEAQEYRLDKEGSPEPWDRNNPLEPKNKARFSIPSITEHHAGRYRCHYYSSAGWSEPSDPLELVMTGAYSKPTLSALPSPVVASGGNMTLQCGSQKGYHHFVLMKEGEHQLPRTLDSQQLHSGGFQALFPVGPVNPSHRWRFTCYYYYMNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSASHAKDYTVENLIRMGMAGLVLVFLGILLFEAQHSQRNPQDAAGR

SEQ ID NO: 46094 - protein, 481 aa, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENSP ID: ENSP00000379651
MTPTLAALLCLGLSLGPRTHVQAGPFPKPTLWAEPGSVISWGSPVTIWCQGSLEAQEYRLDKEGSPEPWDRNNPLEPKNKARFSIPSITEHHAGRYRCHYYSSAGWSEPSDPLELVMTGAYSKPTLSALPSPVVASGGNMTLQCGSQKGYHHFVLMKEGEHQLPRTLDSQQLHSGGFQALFPVGPVNPSHRWRFTCYYYYMNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPASHAKDYTVENLIRMGMAGLVLVFLGILLFEAQHSQRNPQDAAGR

SEQ ID NO: 46095 - protein, 193 aa, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENSP ID: ENSP00000412929
MTPTLAALLCLGLSLGPRTHVQAGPFPKPTLWAEPGSVISWGSPVTIWCQGSLEAQEYRLDKEGSPEPWDRNNPLEPKNKARFSIPSITEHHAGRYRCHYYSSAGWSEPSDPLELVMTGAYSKPTLSALPSPVVASGGNMTLQCGSQKGYHHFVLMKEGEHQLPRTLDSQQLHSGGFQALFPVGPVNPSHRRV

SEQ ID NO: 46096 - protein, 382 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000478126
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPQVWSHPSDPLEILPSGQIYDTVSLSAQPGPTVASGENVTLLCQSRGYFDTFLLTKEGAAHPPLRLRSMYGAHKYQAEFPMSPVTSAHAGTYRCYGSRSSNPHLLSHPSEPLELMVSGHSGGSSLPPTGPPSTPASHAKDYTVENLIRMGMAGLVLVFLGILLFEAQHSQRNPQDAAGR

SEQ ID NO: 46097 - protein, 193 aa, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENSP ID: ENSP00000478128
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRRV

SEQ ID NO: 46098 - protein, 193 aa, Homo sapiens; identical to SEQ ID NO: 46095
  Payload ID: 9414
  Gene Symbol: LILRA6
  Gene Name: leukocyte immunoglobulin-like receptor, subfamily A (with TM domain), member 6
  ENSP ID: ENSP00000478149

SEQ ID NO: 46099 - protein, 632 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000478681
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPQVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSRSSNPHLLSHPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46100 - protein, 193 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000478772
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRRV

SEQ ID NO: 46101 - protein, 193 aa, Homo sapiens; identical to SEQ ID NO: 46097
  Payload ID: 9414
  Gene Symbol: LILRA6
  Gene Name: leukocyte immunoglobulin-like receptor, subfamily A (with TM domain), member 6
  Uniprot ID: Q6PI73
  ENSP ID: ENSP00000478896

SEQ ID NO: 46102 - protein, 512 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000479351
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPQVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSRSSNPHLLSHPSEPLELMVSGHSGGSSLPPTGPPSTPGESLRPLGERGLPQGSLSLPKDPTPLPSRTGLCPRGSEAGLVKSGGQGRERCWGPARRRSRADVGSKVAPGFTSLS

SEQ ID NO: 46103 - protein, 193 aa, Homo sapiens; identical to SEQ ID NO: 46097
  Payload ID: 9414
  Gene Symbol: LILRA6
  Gene Name: leukocyte immunoglobulin-like receptor, subfamily A (with TM domain), member 6
  Uniprot ID: Q6PI73
  ENSP ID: ENSP00000479375

SEQ ID NO: 46104 - protein, 504 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000479640
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSYSSNPHLLSFPSEPLELMVSGHSGGSSLPPTGPPSTPGESLRPRGERGLPQGSLSLPKDPTPLPSRTGLCPRGSEAGLVKSGGFKAERDVGAQPGGGAGLMWGAR

SEQ ID NO: 46105 - protein, 632 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000479666
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSYSSNPHLLSFPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46106 - protein, 382 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000480190
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGQIYDTVSLSAQPGPTVASGENVTLLCQSRGYFDTFLLTKEGAAHPPLRLRSMYGAHKYQAEFPMSPVTSAHAGTYRCYGSRSSNPHLLSHPSEPLELMVSGPSGGSSLPPTGPPSTPASHAKDYTVENLIRMGMAGLVLVFLGILLFEAQHSQRNPQDAAGR

SEQ ID NO: 46107 - protein, 481 aa, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENSP ID: ENSP00000480300
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSYSSNPHLLSFPSEPLELMVSGHSGGSSLPPTGPPSTPASHAKDYTVENLIRMGMAGLVLVFLGILLFEAQHSQRNPQDAAGR

SEQ ID NO: 46108 - protein, 382 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000480591
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGQIYDTVSLSAQPGPTVASGENVTLLCQSRGYFDTFLLTKEGAAHPPLRLRSMYGAHKYQAEFPMSPVTSAHAGTYRCYGSYSSNPHLLSFPSEPLELMVSGHSGGSSLPPTGPPSTPASHAKDYTVENLIRMGMAGLVLVFLGILLFEAQHSQRNPQDAAGR

SEQ ID NO: 46109 - protein, 481 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000480624
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPQVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSRSSNPHLLSHPSEPLELMVSGHSGGSSLPPTGPPSTPASHAKDYTVENLIRMGMAGLVLVFLGILLFEAQHSQRNPQDAAGR

SEQ ID NO: 46110 - protein, 648 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000481047
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSRSSNPHLLSHPSEPLELMVSGHSGGSSLPPTGPPSTPGGPEDQPLNPPGSGPQNGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46111 - protein, 481 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000481288
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSRSSNPHLLSHPSEPLELMVSGPSGGSSLPPTGPPSTPASHAKDYTVENLIRMGMAGLVLVFLGILLFEAQHSQRNPQDAAGR

SEQ ID NO: 46112 - protein, 504 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000482776
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSRSSNPHLLSHPSEPLELMVSGPSGGSSLPPTGPPSTPGESLRPRGERGLPQGSLSLPKDPTPLPSRTGLCPRGSEAGLVKSGGFKAERDVGAQPGGGAGLMWGAR

SEQ ID NO: 46113 - protein, 504 aa, Homo sapiens; identical to SEQ ID NO: 46104
  Payload ID: 9414
  Gene Symbol: LILRA6
  Gene Name: leukocyte immunoglobulin-like receptor, subfamily A (with TM domain), member 6
  ENSP ID: ENSP00000482843

SEQ ID NO: 46114 - protein, 504 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000483257
MTPTLAALLCLGLSLGPRTHVQAGPFPKPTLWAEPGSVISWGSPVTIWCQGSLEAQEYRLDKEGSPEPWDRNNPLEPKNKARFSIPSITEHHAGRYRCHYYSSAGWSEPSDPLELVMTGAYSKPTLSALPSPVVASGGNMTLQCGSQKGYHHFVLMKEGEHQLPRTLDSQQLHSGGFQALFPVGPVNPSHRWRFTCYYYYMNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPGESLRPRGERGLPQGSLSLPKDPTPLPSRTGLCPRGSEAGLVKSGGFKAERDVGAQPGGGAGLMWGAR

SEQ ID NO: 46115 - protein, 193 aa, Homo sapiens; identical to SEQ ID NO: 46095
  Payload ID: 9414
  Gene Symbol: LILRA6
  Gene Name: leukocyte immunoglobulin-like receptor, subfamily A (with TM domain), member 6
  ENSP ID: ENSP00000483476

SEQ ID NO: 46116 - protein, 512 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000483697
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSYSSNPHLLSFPSEPLELMVSGHSGGSSLPPTGPPSTPGESLRPRGERRLPQGSLSLPKDPTPLPSRTGLCPRGSEAGLVKSGGRGRGRCWGPARRRSRADVGGKTAPAFTSLS

SEQ ID NO: 46117 - protein, 193 aa, Homo sapiens; identical to SEQ ID NO: 46097
  Payload ID: 9414
  Gene Symbol: LILRA6
  Gene Name: leukocyte immunoglobulin-like receptor, subfamily A (with TM domain), member 6
  Uniprot ID: Q6PI73
  ENSP ID: ENSP00000483909

SEQ ID NO: 46118 - protein, 191 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000483950
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHS

SEQ ID NO: 46119 - protein, 648 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000484147
MTPTLAALLCLGLSLGPRTHVQAGPFPKPTLWAEPGSVISWGSPVTIWCQGSLEAQEYRLDKEGSPEPWDRNNPLEPKNKARFSIPSITEHHAGRYRCHYYSSAGWSEPSDPLELVMTGAYSKPTLSALPSPVVASGGNMTLQCGSQKGYHHFVLMKEGEHQLPRTLDSQQLHSGGFQALFPVGPVNPSHRWRFTCYYYYMNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGGPEDQPLNPPGSGPQNRLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46120 - protein, 632 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000484396
MTPTLAALLCLGLSLGPRTHVQAGPFPKPTLWAEPGSVISWGSPVTIWCQGSLEAQEYRLDKEGSPEPWDRNNPLEPKNKARFSIPSITEHHAGRYRCHYYSSAGWSEPSDPLELVMTGAYSKPTLSALPSPVVASGGNMTLQCGSQKGYHHFVLMKEGEHQLPRTLDSQQLHSGGFQALFPVGPVNPSHRWRFTCYYYYMNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46121 - protein, 382 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000484399
MTPTLAALLCLGLSLGPRTHVQAGPFPKPTLWAEPGSVISWGSPVTIWCQGSLEAQEYRLDKEGSPEPWDRNNPLEPKNKARFSIPSITEHHAGRYRCHYYSSAGWSEPSDPLELVMTGAYSKPTLSALPSPVVASGGNMTLQCGSQKGYHHFVLMKEGEHQLPRTLDSQQLHSGGFQALFPVGPVNPSHRWRFTCYYYYMNTPRVWSHPSDPLEILPSGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPASHAKDYTVENLIRMGMAGLVLLFLGILLFEAQHSQRNPQDAAGR

SEQ ID NO: 46122 - protein, 481 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000484543
MTPTLAALLCLGLSLGPRTHVQAGPFPKPTLWAEPGSVISWGSPVTIWCQGSLEAQEYRLDKEGSPEPWDRNNPLEPKNKARFSIPSITEHHAGRYRCHYYSSAGWSEPSDPLELVMTGAYSKPTLSALPSPVVASGGNMTLQCGSQKGYHHFVLMKEGEHQLPRTLDSQQLHSGGFQALFPVGPVNPSHRWRFTCYYYYMNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPASHAKDYTVENLIRMGMAGLVLLFLGILLFEAQHSQRNPQDAAGR

SEQ ID NO: 46123 - protein, 193 aa, Homo sapiens; identical to SEQ ID NO: 46097
  Payload ID: 9414
  Gene Symbol: LILRA6
  Gene Name: leukocyte immunoglobulin-like receptor, subfamily A (with TM domain), member 6
  Uniprot ID: Q6PI73
  ENSP ID: ENSP00000484617

SEQ ID NO: 46124 - protein, 512 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000484821
MTPTLAALLCLGLSLGPRTHVQAGPFPKPTLWAEPGSVISWGSPVTIWCQGSLEAQEYRLDKEGSPEPWDRNNPLEPKNKARFSIPSITEHHAGRYRCHYYSSAGWSEPSDPLELVMTGAYSKPTLSALPSPVVASGGNMTLQCGSQKGYHHFVLMKEGEHQLPRTLDSQQLHSGGFQALFPVGPVNPSHRWRFTCYYYYMNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPGESLRPRGERRLPQGSLSLPKDPTPLPSRTGLCPRGSEAGLVKSGGRGRGRCWGPARRRSRADVGGKTAPAFTSLS

SEQ ID NO: 46125 - protein, 632 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000484822
MTPTLAALLCLGLSLGPRTHVQAGPFPKPTLWAEPGSVISWGSPVTIWCQGSLEAQEYRLDKEGSPEPWDRNNPLEPKNKARFSIPSITEHHAGRYRCHYYSSAGWSEPSDPLELVMTGAYSKPTLSALPSPVVASGGNMTLQCGSQKGYHHFVLMKEGEHQLPRTLDSQQLHSGGFQALFPVGPVNPSHRWRFTCYYYYMNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46126 - protein, 481 aa, Homo sapiens
  Payload ID: 9414
  Gene Symbol: LILRA6
  Gene Name: leukocyte immunoglobulin-like receptor, subfamily A (with TM domain), member 6
  ENSP ID: ENSP00000484823
MTPTLAALLCLGLSLGPRTHVQAGPFPKPTLWAEPGSVISWGSPVTIWCQGSLEAQEYRLDKEGSPEPWDRNNPLEPKNKARFSIPSITEHHAGRYRCHYYSSAGWSEPSDPLELVMTGAYSKPTLSALPSPVVASGGNMTLQCGSQKGYHHFVLMKEGEHQLPRTLDSQQLHSGGFQALFPVGPVNPSHRWRFTCYYYYMNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGTLWRLQPPTHRAALHTPASHAKDYTVENLIRMGMAGLVLLFLGILLFEAQHSQRNPQDAAG

SEQ ID NO: 46127 - protein, 375 aa, Homo sapiens
  Payload ID: 9415
  Gene Symbol: LILRA3
  Gene Name: leukocyte immunoglobulin-like receptor, subfamily A (without TM domain), member 3
  ENSP ID: ENSP00000477708
MTPILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTAGLSESSDPLELVVTGAYSKPTLSALPSPVVTSGGNVTIQCDSQVAFDGFILCVSKKPSLSVQPGPVVAPGEKLTFQCGSDAGYDRFVLYKEWGRDFLQRPGRQPQAGLSQANFTLGPVSRSYGGQYTCSGAYNLSSEWSAPSDPLDILITGQIRARPFLSVRPGPTVASGENVTLLCQSQGGMHTFLLTKEGAADSPLRLKSKRQSHKYQAEFPMSPVTSAHAGTYRCYGSLSSNPYLLTHPSDPLELVVSGAAETLSPPQNKSDSKAGE

SEQ ID NO: 46128 - protein, 105 aa, Homo sapiens
  Payload ID: 9415
  Gene Symbol: LILRA3
  Gene Name: leukocyte immunoglobulin-like receptor, subfamily A (without TM domain), member 3
  ENSP ID: ENSP00000478008
MTPILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTA

SEQ ID NO: 46129 - protein, 105 aa, Homo sapiens; identical to SEQ ID NO: 46128
  Payload ID: 9415
  Gene Symbol: LILRA3
  Gene Name: leukocyte immunoglobulin-like receptor, subfamily A (without TM domain), member 3
  ENSP ID: ENSP00000478021

SEQ ID NO: 46130 - protein, 489 aa, Homo sapiens
  Payload ID: 9415
  Gene Symbol: LILRA3
  Gene Name: leukocyte immunoglobulin-like receptor, subfamily A (without TM domain), member 3
  ENSP ID: ENSP00000478188
MTPILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTAGLSESSDPLELVVTGAYSKPTLSALPSPVVTSGGNVTIQCDSQVAFDGFILCKEGEDEHPQCLNSHSHARGSSRAIFSVGPVSPSRRWSYRCYGYDSRAPYVWSLPSDLLGLLVPGVSKKPSLSVQPGPVVAPGEKLTFQCGSDAGYDRFVLYKEWGRDFLQRPGRQPQAGLSQANFTLGPVSRSYGGQYTCSGAYNLSSEWSAPSDPLDILITGQIRARPFLSVRPGPTVASGENVTLLCQSQGGMHTFLLTKEGAADSPLRLKSKRQSHKYQAEFPMSPVTSAHAGTYRCYGSLSSNPYLLTHPSDPLELVVSGAAETLSPPQNKSDSKAGAADTLSPSQNNPTSHPQDYTVENLIHMGKAGLILVVLRILLFEAQHSQRSP

SEQ ID NO: 46131 - protein, 37 aa, Homo sapiens
  Payload ID: 9415
  Gene Symbol: LILRA3
  Gene Name: leukocyte immunoglobulin-like receptor, subfamily A (without TM domain), member 3
  ENSP ID: ENSP00000478798
MTPILTVLICLGLSLDPRTHVQAGPLPKPTLWAEPGS

SEQ ID NO: 46132 - protein, 254 aa, Homo sapiens
  Payload ID: 9415
  Gene Symbol: LILRA3
  Gene Name: leukocyte immunoglobulin-like receptor, subfamily A (without TM domain), member 3
  ENSP ID: ENSP00000478806
MHRGLIHPQSSAVGGDAMTPILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTAGLSESSDPLELVVTGAYSKPTLSALPSPVVTSGGNVTIQCDSQVAFDGFILCKEGEDEHPQCLNSHSHARGSSRAIFSVGPVSPSRRWSYRCYGYDSRAPYVWSLPSDLLGLLVPGAAETLSPPQNKSDSKA

SEQ ID NO: 46133 - protein, 105 aa, Homo sapiens; identical to SEQ ID NO: 46128
  Payload ID: 9415
  Gene Symbol: LILRA3
  Gene Name: leukocyte immunoglobulin-like receptor, subfamily A (without TM domain), member 3
  ENSP ID: ENSP00000478906

SEQ ID NO: 46134 - protein, 205 aa, Homo sapiens
  Payload ID: 9415
  Gene Symbol: LILRA3
  Gene Name: leukocyte immunoglobulin-like receptor, subfamily A (without TM domain), member 3
  ENSP ID: ENSP00000479345
MTPILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTAGLSSKRQSHKYQAEFPMSPVTSAHAGTYRCYGSLSSNPYLLTHPSDPLELVVSASPTSHPQDYTVENLIHMGKAGLILVVLRILLFEAQHSQRSPDAARR

SEQ ID NO: 46135 - protein, 37 aa, Homo sapiens; identical to SEQ ID NO: 46131
  Payload ID: 9415
  Gene Symbol: LILRA3
  Gene Name: leukocyte immunoglobulin-like receptor, subfamily A (without TM domain), member 3
  ENSP ID: ENSP00000479942

SEQ ID NO: 46136 - protein, 489 aa, Homo sapiens; identical to SEQ ID NO: 46130
  Payload ID: 9415
  Gene Symbol: LILRA3
  Gene Name: leukocyte immunoglobulin-like receptor, subfamily A (without TM domain), member 3
  ENSP ID: ENSP00000480252

SEQ ID NO: 46137 - protein, 37 aa, Homo sapiens; identical to SEQ ID NO: 46131
  Payload ID: 9415
  Gene Symbol: LILRA3
  Gene Name: leukocyte immunoglobulin-like receptor, subfamily A (without TM domain), member 3
  ENSP ID: ENSP00000480375

SEQ ID NO: 46138 - protein, 439 aa, Homo sapiens
  Payload ID: 9415
  Gene Symbol: LILRA3
  Gene Name: leukocyte immunoglobulin-like receptor, subfamily A (without TM domain), member 3
  Uniprot ID: Q8N6C8
  ENSP ID: ENSP00000480386
MTPILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTAGLSESSDPLELVVTGAYSKPTLSALPSPVVTSGGNVTIQCDSQVAFDGFILCKEGEDEHPQCLNSHSHARGSSRAIFSVGPVSPSRRWSYRCYGYDSRAPYVWSLPSDLLGLLVPGVSKKPSLSVQPGPVVAPGEKLTFQCGSDAGYDRFVLYKEWGRDFLQRPGRQPQAGLSQANFTLGPVSRSYGGQYTCSGAYNLSSEWSAPSDPLDILITGQIRARPFLSVRPGPTVASGENVTLLCQSQGGMHTFLLTKEGAADSPLRLKSKRQSHKYQAEFPMSPVTSAHAGTYRCYGSLSSNPYLLTHPSDPLELVVSGAAETLSPPQNKSDSKAGE

SEQ ID NO: 46139 - protein, 439 aa, Homo sapiens; identical to SEQ ID NO: 46138
  Payload ID: 9415
  Gene Symbol: LILRA3
  Gene Name: leukocyte immunoglobulin-like receptor, subfamily A (without TM domain), member 3
  ENSP ID: ENSP00000481818

SEQ ID NO: 46140 - protein, 439 aa, Homo sapiens; identical to SEQ ID NO: 46138
  Payload ID: 9415
  Gene Symbol: LILRA3
  Gene Name: leukocyte immunoglobulin-like receptor, subfamily A (without TM domain), member 3
  Uniprot ID: Q8N6C8
  ENSP ID: ENSP00000482971

SEQ ID NO: 46141 - protein, 489 aa, Homo sapiens; identical to SEQ ID NO: 46130
  Payload ID: 9415
  Gene Symbol: LILRA3
  Gene Name: leukocyte immunoglobulin-like receptor, subfamily A (without TM domain), member 3
  ENSP ID: ENSP00000483374

SEQ ID NO: 46142 - protein, 439 aa, Homo sapiens; identical to SEQ ID NO: 46138
  Payload ID: 9415
  Gene Symbol: LILRA3
  Gene Name: leukocyte immunoglobulin-like receptor, subfamily A (without TM domain), member 3
  Uniprot ID: Q8N6C8
  ENSP ID: ENSP00000484119

SEQ ID NO: 46143 - protein, 489 aa, Homo sapiens; identical to SEQ ID NO: 46130
  Payload ID: 9415
  Gene Symbol: LILRA3
  Gene Name: leukocyte immunoglobulin-like receptor, subfamily A (without TM domain), member 3
  ENSP ID: ENSP00000484564

SEQ ID NO: 46144 - protein, 652 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000315997
MTPILTVLICLGLSLGPRTHVQAGHLPKPTLWAEPGSVITQGSPVTLRCQGGQETQEYRLYREKKTAPWITRIPQELVKKGQFPIPSITWEHTGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46145 - protein, 652 aa, Homo sapiens; identical to SEQ ID NO: 46144
  Payload ID: 9416
  Gene Symbol: LILRB1
  Gene Name: leukocyte immunoglobulin-like receptor, subfamily B (with TM and ITIM domains), member 1
  ENSP ID: ENSP00000379608

SEQ ID NO: 46146 - protein, 634 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000379610
MTPILTVLICLGLSLGPRTHVQAGHLPKPTLWAEPGSVITQGSPVTLRCQGGQETQEYRLYREKKTAPWITRIPQELVKKGQFPIPSITWEHTGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46147 - protein, 651 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000379618
MTPILTVLICLGLSLGPRTHVQAGHLPKPTLWAEPGSVITQGSPVTLRCQGGQETQEYRLYREKKTAPWITRIPQELVKKGQFPIPSITWEHTGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46148 - protein, 650 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000379622
MTPILTVLICLGLSLGPRTHVQAGHLPKPTLWAEPGSVITQGSPVTLRCQGGQETQEYRLYREKKTAPWITRIPQELVKKGQFPIPSITWEHTGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46149 - protein, 651 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000379623
MTPILTVLICLGLSLGPRTHVQAGHLPKPTLWAEPGSVITQGSPVTLRCQGGQETQEYRLYREKKTAPWITRIPQELVKKGQFPIPSITWEHTGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46150 - protein, 701 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000395004
MRRRTQPPIGHTLCVSLSCQHRGLIHPQSRAVGGDAMTPILTVLICLGLSLGPRTHVQAGHLPKPTLWAEPGSVITQGSPVTLRCQGGQETQEYRLYREKKTAPWITRIPQELVKKGQFPIPSITWEHTGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSAPGLGSGAGTRAAGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46151 - protein, 510 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000410165
MTPILTVLICLGLSLGPRTHVQAGHLPKPTLWAEPGSVITQGSPVTLRCQGGQETQEYRLYREKKTAPWITRIPQELVKKGQFPIPSITWEHTGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSSPAQLPMPRKKTSMLP

SEQ ID NO: 46152 - protein, 684 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000477838
  MOD_RES (1)..(1): Any amino acid
XCQHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSAPGLGSGAGTRAAGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46153 - protein, 651 aa, Homo sapiens
  Payload ID: 9416
  Gene Symbol: LILRB1
  Gene Name: leukocyte immunoglobulin-like receptor, subfamily B (with TM and ITIM domains), member 1
  Uniprot ID: Q8NHL6
  ENSP ID: ENSP00000478282
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46154 - protein, 651 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000478831
MTPILTVLICLGLSLGPRTHVQAGHLPKPTLWAEPGSVITQGSPVTLRCQGGQETQEYRLYREKKTAPWITRIPQELVKKGQFPIPSITWEHAGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRRKATEPPPSQEGPSPAVPSIYATLAIH

SEQ ID NO: 46155 - protein, 67 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000479156
EFLDTKDRQAEEDRQMDTEAAASEAPQDVTYAQLHSLTLRREATEPPPSQEGPSPAVPSIYATLAIH

SEQ ID NO: 46156 - protein, 485 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000479503
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAAHPLLHLRSEHGAQQHQAEFPMSPVTSVHGGTYRCFSSHGFSHYLLSHPSDPLELIVSGAADTLSPSQNKSDSETASPASHLQDYAVENLIHMGVAGLILVVLGILSFEAWHSQRSFQDAAGR

SEQ ID NO: 46157 - protein, 651 aa, Homo sapiens
  Payload ID: 9416
  Gene Symbol: LILRB1
  Gene Name: leukocyte immunoglobulin-like receptor, subfamily B (with TM and ITIM domains), member 1
  Uniprot ID: Q8NHL6
  ENSP ID: ENSP00000479753
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46158 - protein, 652 aa, Homo sapiens
  Payload ID: 9416
  Gene Symbol: LILRB1
  Gene Name: leukocyte immunoglobulin-like receptor, subfamily B (with TM and ITIM domains), member 1
  Uniprot ID: Q8NHL6
  ENSP ID: ENSP00000479887
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46159 - protein, 485 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000480162
MTPILTVLICLGLSLGPRTHVQAGHLPKPTLWAEPGSVITQGSPVTLRCQGGQETQEYRLYREKKTAPWITRIPQELVKKGQFPIPSITWEHAGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAAHPLLHLRSEHGAQQHQAEFPMSPVTSVHGGTYRCFSSHGFSHYLLSHPSDPLELIVSGAADTLSPSQNKSDSETASPASHLQDYAVENLIHMGVAGLILVVLGILSFEAWHSQRSFQDAAGR

SEQ ID NO: 46160 - protein, 485 aa, Homo sapiens; identical to SEQ ID NO: 46156
  Payload ID: 9416
  Gene Symbol: LILRB1
  Gene Name: leukocyte immunoglobulin-like receptor, subfamily B (with TM and ITIM domains), member 1
  ENSP ID: ENSP00000480213

SEQ ID NO: 46161 - protein, 67 aa, Homo sapiens; identical to SEQ ID NO: 46155
  Payload ID: 9416
  Gene Symbol: LILRB1
  Gene Name: leukocyte immunoglobulin-like receptor, subfamily B (with TM and ITIM domains), member 1
  ENSP ID: ENSP00000480259

SEQ ID NO: 46162 - protein, 456 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000480352
MTPILTVLICLGHLPKPTLWAEPGSVITQGSPVTLRCQGGQETQEYRLYREKKTAPWITRIPQELVKKGQFPIPSITWEHAGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAAHPLLHLRSEHGAQQHQAEFPMSPVTSVHGGTYRCFSSHGFSHYLLSHPSDPLELIVSASPASHLQDYAVENLIHMGVAGLILVVLGILSFEAWHSQRSFQDAAGR

SEQ ID NO: 46163 - protein, 650 aa, Homo sapiens
  Payload ID: 9416
  Gene Symbol: LILRB1
  Gene Name: leukocyte immunoglobulin-like receptor, subfamily B (with TM and ITIM domains), member 1
  Uniprot ID: Q8NHL6
  ENSP ID: ENSP00000480365
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46164 - protein, 510 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000481605
  MOD_RES (1)..(1): Any amino acid
XTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSSPAQLPMPRKKTSMLP

SEQ ID NO: 46165 - protein, 650 aa, Homo sapiens
  Payload ID: 9416
  Gene Symbol: LILRB1
  Gene Name: leukocyte immunoglobulin-like receptor, subfamily B (with TM and ITIM domains), member 1
  Uniprot ID: Q8NHL6
  ENSP ID: ENSP00000481700
MTPILTVLICLGLSLGPRTHVQAGHLPKPTLWAEPGSVITQGSPVTLRCQGGQETQEYRLYREKKTAPWITRIPQELVKKGQFPIPSITWEHAGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRRKATEPPPSQEGPSPAVPSIYATLAIH

SEQ ID NO: 46166 - protein, 667 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000481701
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46167 - protein, 652 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000481891
MTPILTVLICLGLSLGPRTHVQAGHLPKPTLWAEPGSVITQGSPVTLRCQGGQETQEYRLYREKKTAPWITRIPQELVKKGQFPIPSITWEHAGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRRKATEPPPSQEGPSPAVPSIYATLAIH

SEQ ID NO: 46168 - protein, 510 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000481949
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSSPAQLPMPRKKTSMLP

SEQ ID NO: 46169 - protein, 652 aa, Homo sapiens; identical to SEQ ID NO: 46167
  Payload ID: 9416
  Gene Symbol: LILRB1
  Gene Name: leukocyte immunoglobulin-like receptor, subfamily B (with TM and ITIM domains), member 1
  ENSP ID: ENSP00000481972

SEQ ID NO: 46170 - protein, 634 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000482054
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46171 - protein, 67 aa, Homo sapiens; identical to SEQ ID NO: 46155
  Payload ID: 9416
  Gene Symbol: LILRB1
  Gene Name: leukocyte immunoglobulin-like receptor, subfamily B (with TM and ITIM domains), member 1
  ENSP ID: ENSP00000482125

SEQ ID NO: 46172 - protein, 668 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000482978
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46173 - protein, 652 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000483139
  MOD_RES (1)..(1): Any amino acid
XTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46174 - protein, 67 aa, Homo sapiens; identical to SEQ ID NO: 46155
  Payload ID: 9416
  Gene Symbol: LILRB1
  Gene Name: leukocyte immunoglobulin-like receptor, subfamily B (with TM and ITIM domains), member 1
  ENSP ID: ENSP00000484046

SEQ ID NO: 46175 - protein, 456 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000484156
MTPILTVLICLGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAAHPLLHLRSEHGAQQHQAEFPMSPVTSVHGGTYRCFSSHGFSHYLLSHPSDPLELIVSASPASHLQDYAVENLIHMGVAGLILVVLGILSFEAWHSQRSFQDAAGR

SEQ ID NO: 46176 - protein, 668 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000484746
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 46177 - protein, 651 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000484936
MTPILTVLICLGLSLGPRTHVQAGHLPKPTLWAEPGSVITQGSPVTLRCQGGQETQEYRLYREKKTAPWITRIPQELVKKGQFPIPSITWEHAGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRRKATEPPPSQEGPSPAVPSIYATLAIH

SEQ ID NO: 46178 - protein, 634 aa, Homo sapiens; identical to SEQ ID NO: 46170
  Payload ID: 9416
  Gene Symbol: LILRB1
  Gene Name: leukocyte immunoglobulin-like receptor, subfamily B (with TM and ITIM domains), member 1
  ENSP ID: ENSP00000484938

SEQ ID NO: 46179 - protein, 206 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000486125
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSSEHGAQQHQAEFPMSPVTSAHTGTYRCYGSLSSDPYLLSHPSGPVELVVSASPASHLQDYAVENLIHMGVAGLILVVLGILSFEAWHSQRSFQDAAGR

SEQ ID NO: 46180 - protein, 206 aa, Homo sapiens; identical to SEQ ID NO: 46179
  Payload ID: 9416
  Gene Symbol: LILRB1
  Gene Name: leukocyte immunoglobulin-like receptor, subfamily B (with TM and ITIM domains), member 1
  ENSP ID: ENSP00000486644

SEQ ID NO: 46181 - protein, 206 aa, Homo sapiens
  Payload ID: 9416
  Gene Symbol: LILRB1
  Gene Name: leukocyte immunoglobulin-like receptor, subfamily B (with TM and ITIM domains), member 1
  ENSP ID: ENSP00000487378
MTPILTVLICLGLSLGPRTHVQAGHLPKPTLWAEPGSVITQGSPVTLRCQGGQETQEYRLYREKKTAPWITRIPQELVKKGQFPIPSITWEHAGRYRCYYGSDTAGRSSEHGAQQHQAEFPMSPVTSAHTGTYRCYGSLSSDPYLLSHPSGPVELVVSASPASHLQDYAVENLIHMGVAGLILVVLGILSFEAWHSQRSFQDAAGR

SEQ ID NO: 46182 - protein, 456 aa, Homo sapiens; identical to SEQ ID NO: 46175
  Payload ID: 9416
  Gene Symbol: LILRB1
  Gene Name: leukocyte immunoglobulin-like receptor, subfamily B (with TM and ITIM domains), member 1
  ENSP ID: ENSP00000487401

SEQ ID NO: 46183 - protein, 597 aa, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000319960
MTPIVTVLICLGLSLGPRTRVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVMAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46184 - protein, 510 aa, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000375626
MTPIVTVLICLGLSLGPRTRVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVMAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSSPAQLPTPRKKTSMLP

SEQ ID NO: 46185 - protein, 597 aa, Homo sapiens; identical to SEQ ID NO: 46183
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000375628

SEQ ID NO: 46186 - protein, 598 aa, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000375629
MTPIVTVLICLGLSLGPRTRVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVMAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46187 - protein, 210 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000394130
  MOD_RES (1)..(1): Any amino acid
XFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLCE

SEQ ID NO: 46188 - protein, 482 aa, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000410117
MTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVMAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46189 - protein, 219 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000477879
EFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46190 - protein, 218 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000478328
EFPMSPVTSAHAGTYRCYGSLNSDPYLLSHPSEPLELVVSGPSMGSSPPPTGPISTPGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46191 - protein, 597 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000478648
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAYNLSSEWSAPSDPLDILITGQIHGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEGEPPAEPSIYATLAIH

SEQ ID NO: 46192 - protein, 210 aa, Homo sapiens; identical to SEQ ID NO: 46187
  Payload ID: 9417
  Gene Symbol: LILRB2
  Gene Name: leukocyte immunoglobulin-like receptor, subfamily B (with TM and ITIM domains), member 2
  ENSP ID: ENSP00000480022
  MOD_RES (1)..(1): Any amino acid

SEQ ID NO: 46193 - protein, 37 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000480126
MTPIVTVLICLGLSLGPRTHVQTGTIPKPTLWAEPDS

SEQ ID NO: 46194 - protein, 598 aa, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000480302
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAYNLSSEWSAPSDPLDILITGQIHGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEGEPPAEPSIYATLAIH

SEQ ID NO: 46195 - protein, 602 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000480587
MHRGLIHPQSRAVGGDAMTPIVTVLICLGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46196 - protein, 482 aa, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000480841
MTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46197 - protein, 598 aa, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000481208
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46198 - protein, 498 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000481228
MTPIVTVLICLGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSSPAQLPTPRKKTSMLP

SEQ ID NO: 46199 - protein, 510 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000481364
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAYNLSSEWSAPSDPLDILITGQIHGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSSPAQLPTPRKKTSMLP

SEQ ID NO: 46200 - protein, 510 aa, Homo sapiens; identical to SEQ ID NO: 46199
  Payload ID: 9417
  Gene Symbol: LILRB2
  Gene Name: leukocyte immunoglobulin-like receptor, subfamily B (with TM and ITIM domains), member 2
  ENSP ID: ENSP00000481826

SEQ ID NO: 46201 - protein, 597 aa, Homo sapiens; identical to SEQ ID NO: 46191
  Payload ID: 9417
  Gene Symbol: LILRB2
  Gene Name: leukocyte immunoglobulin-like receptor, subfamily B (with TM and ITIM domains), member 2
  ENSP ID: ENSP00000481897

SEQ ID NO: 46202 - protein, 585 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000482086
MTPIVTVLICLGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46203 - protein, 218 aa, Homo sapiens; identical to SEQ ID NO: 46190
  Payload ID: 9417
  Gene Symbol: LILRB2
  Gene Name: leukocyte immunoglobulin-like receptor, subfamily B (with TM and ITIM domains), member 2
  ENSP ID: ENSP00000482113

SEQ ID NO: 46204 - protein, 597 aa, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000482933
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAYNLSSEWSAPSDPLDILITGQIHGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46205 - protein, 597 aa, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000483014
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46206 - protein, 510 aa, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000483478
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSSPAQLPTPRKKTSMLP

SEQ ID NO: 46207 - protein, 598 aa, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000483553
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAYNLSSEWSAPSDPLDILITGQIHGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46208 - protein, 603 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000483646
MHRGLIHPQSRAVGGDAMTPIVTVLICLGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 46209 - protein, 455 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000484266
MTPIVTVLICLGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVMAPGESLTLQCVSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSASPASHAKDYTVENLIRMGMAGLVLVFLGILLFEAQHSQRNPQDAAGR

SEQ ID NO: 46210 - protein, 597 aa, Homo sapiens; identical to SEQ ID NO: 46204
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENSP ID: ENSP00000484373

SEQ ID NO: 46211 - protein, 54 aa, Homo sapiens
  Payload ID: 9417
  Gene Symbol: LILRB2
  Gene Name: leukocyte immunoglobulin-like receptor, subfamily B (with TM and ITIM domains), member 2
  ENSP ID: ENSP00000484944
MHRGLIHPQSRAVGGDAMTPIVTVLICLGLSLGPRTHVQTGTIPKPTLWAEPDS

SEQ ID NO: 46212 - protein, 632 aa, Homo sapiens
  Payload ID: 9418
  Gene Symbol: LILRB3
  Gene Name: leukocyte immunoglobulin-like receptor, subfamily B (with TM and ITIM domains), member 3
  Uniprot ID: O75022
  ENSP ID: ENSP00000245620
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSRSYGGQYRCYGAHNLSSEWSAPSDPLDILITGQIYDTVSLSAQPGPTVASGENMTLLCQSRGYFDTFLLTKEGAAHPPLRLRSMYGAHKYQAEFPMSPVTSAHAGTYRCYGSRSSNPHLLSFPSEPLELMVSGHSGGSSLPPTGPPSTPGLGRYLEVLIGVSVAFVLLLFLLLFLLLLRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46213 - protein, 643 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000345184
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSRSYGGQYRCYGAHNLSSEWSAPSDPLDILITGQIYDTVSLSAQPGPTVASGENMTLLCQSRGYFDTFLLTKEGAAHPPLRLRSMYGAHKYQAEFPMSPVTSAHAGTYRCYGSRSSNPHLLSFPSEPLELMVSGPEDQPLNPPGSGPQNAPGLGSGAGTRAAGLGRYLEVLIGVSVAFVLLLFLLLFLLLLRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46214 - protein, 631 aa, Homo sapiens
  Payload ID: 9418
  Gene Symbol: LILRB3
  Gene Name: leukocyte immunoglobulin-like receptor, subfamily B (with TM and ITIM domains), member 3
  Uniprot ID: O75022
  ENSP ID: ENSP00000375630
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSRSYGGQYRCYGAHNLSSEWSAPSDPLDILITGQIYDTVSLSAQPGPTVASGENMTLLCQSRGYFDTFLLTKEGAAHPPLRLRSMYGAHKYQAEFPMSPVTSAHAGTYRCYGSRSSNPHLLSFPSEPLELMVSGHSGGSSLPPTGPPSTPGLGRYLEVLIGVSVAFVLLLFLLLFLLLLRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46215 - protein, 158 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000388199
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKE

SEQ ID NO: 46216 - protein, 191 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000416920
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHS

SEQ ID NO: 46217 - protein, 631 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000477806
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46218 - protein, 631 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000477915
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSRSYGGQYRCYGAHNLSSEWSAPSDPLDILITGQIYDTVSLSAQPGPTVASGENVTLLCQSRGYFDTFLLTKEGAAHPPLRLRSMYGAHKYQAEFPMSPVTSAHAGTYRCYGSRSSNPHLLSFPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46219 - protein, 191 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000477956
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKEGEHQLPRTLDSQQLHSRGFQALFPVGPVTPSHS

SEQ ID NO: 46220 - protein, 632 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000478015
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSRSYGGQYRCYGAHNLSSEWSAPSDPLDILITGQIYDTVSLSAQPGPTVASGENVTLLCQSRGYFDTFLLTKEGAAHPPLRLRSMYGAHKYQAEFPMSPVTSAHAGTYRCYGSRSSNPHLLSFPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46221 - protein, 632 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000478538
MTPALTALLCLGLSLGPRTRVQAGPFPKPTLWAEPGSVISWGSPVTIWCQGSLEAQEYRLDKEGSPEPLDRNNPLEPKNKARFSIPSMTEHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVNPSHRWRFTCYYYYMNTPQVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46222 - protein, 632 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000478560
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPQVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46223 - protein, 648 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000479159
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVNPSHRWRFTCYYYYMNTPQVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPGGPEDQPLNPPGSGPQNGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46224 - protein, 631 aa, Homo sapiens
  Payload ID: 9418
  Gene Symbol: LILRB3
  Gene Name: leukocyte immunoglobulin-like receptor, subfamily B (with TM and ITIM domains), member 3
  Uniprot ID: O75022
  ENSP ID: ENSP00000479234
MTPALTALLCLGLSLGPRTRVQAGPFPKPTLWAEPGSVISWGSPVTIWCQGSLEAQEYRLDKEGSPEPLDRNNPLEPKNKARFSIPSMTEHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVNPSHRWRFTCYYYYMNTPQVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46225 - protein, 648 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000479532
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKEGEHQLPRTLDSQQLHSRGFQALFPVGPVTPSHRWRFTCYYYYTNTPWVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGGPEDQPLNPPGSGPQNRLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46226 - protein, 195 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000480236
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRRV

SEQ ID NO: 46227 - protein, 649 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000480276
MTPALTALLCLGLSLGPRTRVQAGPFPKPTLWAEPGSVISWGSPVTIWCQGSLEAQEYRLDKEGSPEPLDRNNPLEPKNKARFSIPSMTEHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVNPSHRWRFTCYYYYMNTPQVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPGGPEDQPLNPPGSGPQNGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46228 - protein, 489 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000480356
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSRSYGGQYRCYGAHNLSSEWSAPSDPLDILITGQIYDTVSLSAQPGPTVASGENVTLLCQSRGYFDTFLLTKEGAAHPPLRLRSMYGAHKYQAEFPMSPVTSAHAGTYRCYGSRSSNPHLLSFPSEPLELMVSGHSGGSSLPPTGPPSTPGLGRYLEVLIGVSVAFVLLLFLLLFLLLRRQRHSKHRTSGLRLCPSSPRPEKD

SEQ ID NO: 46229 - protein, 648 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000480761
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSRSYGGQYRCYGAHNLSSEWSAPSDPLDILITGQIYDTVSLSAQPGPTVASGENVTLLCQSRGYFDTFLLTKEGAAHPPLRLRSMYGAHKYQAEFPMSPVTSAHAGTYRCYGSRSSNPHLLSFPSEPLELMVSGHSGGSSLPPTGPPSTPGGPEDQPLNPPGSGPQNGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46230 - protein, 632 aa, Homo sapiens; identical to SEQ ID NO: 46220
  Payload ID: 9418
  Gene Symbol: LILRB3
  Gene Name: leukocyte immunoglobulin-like receptor, subfamily B (with TM and ITIM domains), member 3
  ENSP ID: ENSP00000481019

SEQ ID NO: 46231 - protein, 191 aa, Homo sapiens; identical to SEQ ID NO: 46216
  Payload ID: 9418
  Gene Symbol: LILRB3
  Gene Name: leukocyte immunoglobulin-like receptor, subfamily B (with TM and ITIM domains), member 3
  ENSP ID: ENSP00000482101

SEQ ID NO: 46232 - protein, 191 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000482207
MTPALTALLCLGLSLGPRTRVQAGPFPKPTLWAEPGSVISWGSPVTIWCQGSLEAQEYRLDKEGSPEPLDRNNPLEPKNKARFSIPSMTEHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVNPSHS

SEQ ID NO: 46233 - protein, 631 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000483441
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSRSSNPHLLSFPSEPLELMVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46234 - protein, 455 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000483574
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKEGEHQLPRTLDSQQLHSRGFQALFPVGPVTPSHRWRFTCYYYYTNTPWVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGEGADPVLSELKGSAQAQAPRRALGWDGPREAVREA

SEQ ID NO: 46235 - protein, 193 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000483616
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRRV

SEQ ID NO: 46236 - protein, 631 aa, Homo sapiens
  Payload ID: 9418
  Gene Symbol: LILRB3
  Gene Name: leukocyte immunoglobulin-like receptor, subfamily B (with TM and ITIM domains), member 3
  Uniprot ID: O75022
  ENSP ID: ENSP00000483625
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKEGEHQLPRTLDSQQLHSRGFQALFPVGPVTPSHRWRFTCYYYYTNTPWVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46237 - protein, 193 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000483760
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKEGEHQLPRTLDSQQLHSRGFQALFPVGPVTPSHRRV

SEQ ID NO: 46238 - protein, 489 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000483815
MTPALTALLCLGLSLGPRTRVQAGPFPKPTLWAEPGSVISWGSPVTIWCQGSLEAQEYRLDKEGSPEPLDRNNPLEPKNKARFSIPSMTEHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVNPSHRWRFTCYYYYMNTPQVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSFPSEPLELMVSGHSGGSSLPPTGPPSTPGLGRYLEVLIGVSVAFVLLLFLLLFLLLRRQRHSKHRTSGLRLCPSSPRPEKD

SEQ ID NO: 46239 - protein, 632 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000484451
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46240 - protein, 648 aa, Homo sapiens
  Payload ID: 9418
  Gene Symbol: LILRB3
  Gene Name: leukocyte immunoglobulin-like receptor, subfamily B (with TM and ITIM domains), member 3
  ENSP ID: ENSP00000484812
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGAYSKPTLSALPSPVVASGGNMTLRCGSQKGYHHFVLMKEGEHQLPRTLDSQQLHSRGFQALFPVGPVTPSHRWRFTCYYYYTNTPWVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGGPEDQPLNPPGSGPQNRLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 46241 - protein, 631 aa, Homo sapiens; identical to SEQ ID NO: 46224
  Payload ID: 9418
  Gene Symbol: LILRB3
  Gene Name: leukocyte immunoglobulin-like receptor, subfamily B (with TM and ITIM domains), member 3
  Uniprot ID: O75022
  ENSP ID: ENSP00000484925

SEQ ID NO: 46242 - protein, 131 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000270452
MEQPHDEKDPASKRPHPVCLFVLPALRTHPSAQLGPLGGDAMIPTFTALLCLGLSLGPRTHMQAGPLPKPTLWAEPGSVISWGNSVTIWCQGTLEAREYRLDKEESPAPWDRQNPLEPKNKARFSIPSMTE

SEQ ID NO: 46243 - protein, 449 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000375613
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFSGAAVKNTQPEDGVEMDTRQSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46244 - protein, 395 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000375614
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRAAASEAPQDVTYARLHSFTLRQKATEPPPSQEGASPAEPSVYATLAIH

SEQ ID NO: 46245 - protein, 448 aa, Homo sapiens
  Payload ID: 9419
  Gene Symbol: LILRB4
  Gene Name: leukocyte immunoglobulin-like receptor, subfamily B (with TM and ITIM domains), member 4
  Uniprot ID: Q8NHJ6
  ENSP ID: ENSP00000375616
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46246 - protein, 399 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000401962
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTE

SEQ ID NO: 46247 - protein, 447 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000408995
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46248 - protein, 448 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000478077
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKDTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 46249 - protein, 437 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000478476
MIPTLTALLCLGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFSGAAVKNTQPEDGVEMDTRQSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46250 - protein, 399 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000478511
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEDPRPSPTRSVSTAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTE

SEQ ID NO: 46251 - protein, 449 aa, Homo sapiens
  Payload ID: 9419
  Gene Symbol: LILRB4
  Gene Name: leukocyte immunoglobulin-like receptor, subfamily B (with TM and ITIM domains), member 4
  Uniprot ID: Q8NHJ6
  ENSP ID: ENSP00000478542
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEDPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFSGAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 46252 - protein, 447 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000478584
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKDTQPEDGVEMDTRSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 46253 - protein, 448 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000478727
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFSGAAVKDTQPEDGVEMDTRSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 46254 - protein, 449 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000479289
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFSGAAVKDTQPEDGVEMDTRQSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46255 - protein, 448 aa, Homo sapiens; identical to SEQ ID NO: 46248
  Payload ID: 9419
  Gene Symbol: LILRB4
  Gene Name: leukocyte immunoglobulin-like receptor, subfamily B (with TM and ITIM domains), member 4
  ENSP ID: ENSP00000479497

SEQ ID NO: 46256 - protein, 448 aa, Homo sapiens
  Payload ID: 9419
  Gene Symbol: LILRB4
  Gene Name: leukocyte immunoglobulin-like receptor, subfamily B (with TM and ITIM domains), member 4
  Uniprot ID: Q8NHJ6
  ENSP ID: ENSP00000479829
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEDPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 46257 - protein, 280 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000480977
MTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEDPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRSPHDEDPQAVTYAKVKHSRP

SEQ ID NO: 46258 - protein, 448 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000481233
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFSGAAVKDTQPEDGVEMDTRSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46259 - protein, 478 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000481609
MEQPHDEKDPASKRPHPVCLFVLPALRTHPSAQLGPLGGDAMIPTFTALLCLGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEDPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFSGAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 46260 - protein, 447 aa, Homo sapiens
  Payload ID: 9419
  Gene Symbol: LILRB4
  Gene Name: leukocyte immunoglobulin-like receptor, subfamily B (with TM and ITIM domains), member 4
  Uniprot ID: Q8NHJ6
  ENSP ID: ENSP00000482234
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEDPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 46261 - protein, 448 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000482694
MIPTLTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46262 - protein, 447 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000483171
MIPTLTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46263 - protein, 395 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000483296
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEDPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRAAASEAPQDVTYAQLHSFTLRQKATEPPPSQEGASPAEPSVYATLAIH

SEQ ID NO: 46264 - protein, 63 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000483357
MEQPHDEKDPASKRPHPVCLFVLPALRTHPSAQLGPLGGDAMIPTFTALLCLGDPGGSGVPSG

SEQ ID NO: 46265 - protein, 447 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000483376
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKDTQPEDGVEMDTRSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46266 - protein, 168 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000483708
MIPTLTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLR

SEQ ID NO: 46267 - protein, 449 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000484286
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFSGAAVKDTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 46268 - protein, 25 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000484348
  MOD_RES (1)..(1): Any amino acid
XEPKDGGLQRRSSPAADVQGENFCE

SEQ ID NO: 46269 - protein, 449 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000484515
MIPTLTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFSGAAVKNTQPEDGVEMDTRQSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46270 - protein, 448 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000484720
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKDTQPEDGVEMDTRQSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46271 - protein, 448 aa, Homo sapiens
  Payload ID: 9419
  Gene Symbol: LILRB4
  Gene Name: leukocyte immunoglobulin-like receptor, subfamily B (with TM and ITIM domains), member 4
  ENSP ID: ENSP00000484809
MIPTLTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFSGAAVKNTQPEDGVEMDTRSPHDEDPQAVTYAKVKHSRPRREMASPPSPLSGEFLDTKDRQAEEDRQMDTEAAASEAPQDVTYARLHSFTLRQKATEPPPSQEGASPAEPSVYATLAIH

SEQ ID NO: 46272 - protein, 491 aa, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000263430
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDAPAAASEAPQDVTYAQLHSLTLRREATEPPPSQEREPPAEPSIYAPLAIH

SEQ ID NO: 46273 - protein, 590 aa, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000320390
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDAPAAASEAPQDVTYAQLHSLTLRREATEPPPSQEREPPAEPSIYAPLAIH

SEQ ID NO: 46274 - protein, 591 aa, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000406478
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDAPAAASEAPQDVTYAQLHSLTLRREATEPPPSQEREPPAEPSIYAPLAIH

SEQ ID NO: 46275 - protein, 643 aa, Homo sapiens
  Payload ID: 9420
  Gene Symbol: LILRB5
  Gene Name: leukocyte immunoglobulin-like receptor, subfamily B (with TM and ITIM domains), member 5
  ENSP ID: ENSP00000478307
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARQSPHDEDPQAVTYAPVKHSRPRREMASPPSPLSGEFLDTKDRQAEEDRQMDTEAAASEAPQDVTYAQLHSLTLRREATEPPPSQEREPPAEPSIYAPLAIH

SEQ ID NO: 46276 - protein, 590 aa, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000478835
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 46277 - protein, 591 aa, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000478912
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 46278 - protein, 491 aa, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000479022
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 46279 - protein, 591 aa, Homo sapiens; identical to SEQ ID NO: 46277
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000479413

SEQ ID NO: 46280 - protein, 158 aa, Homo sapiens
  Payload ID: 9420
  Gene Symbol: LILRB5
  Gene Name: leukocyte immunoglobulin-like receptor, subfamily B (with TM and ITIM domains), member 5
  ENSP ID: ENSP00000479798
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEE

SEQ ID NO: 46281 - protein, 622 aa, Homo sapiens
  Payload ID: 9420
  Gene Symbol: LILRB5
  Gene Name: leukocyte immunoglobulin-like receptor, subfamily B (with TM and ITIM domains), member 5
  ENSP ID: ENSP00000480208
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARQSPHDEDPQAVTYAEVKHSRPRREMASPPSPLSGEFLDTKDRQAEEDRQMDTERVLSSPGPQASPPPPRSLPLTLPRCRLLHLKPPRM

SEQ ID NO: 46282 - protein, 491 aa, Homo sapiens; identical to SEQ ID NO: 46278
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000480909

SEQ ID NO: 46283 - protein, 591 aa, Homo sapiens; identical to SEQ ID NO: 46277
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000481263

SEQ ID NO: 46284 - protein, 151 aa, Homo sapiens
  Payload ID: 9420
  Gene Symbol: LILRB5
  Gene Name: leukocyte immunoglobulin-like receptor, subfamily B (with TM and ITIM domains), member 5
  ENSP ID: ENSP00000481277
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLL

SEQ ID NO: 46285 - protein, 643 aa, Homo sapiens; identical to SEQ ID NO: 46275
  Payload ID: 9420
  Gene Symbol: LILRB5
  Gene Name: leukocyte immunoglobulin-like receptor, subfamily B (with TM and ITIM domains), member 5
  ENSP ID: ENSP00000481829

SEQ ID NO: 46286 - protein, 160 aa, Homo sapiens
  Payload ID: 9420
  Gene Symbol: LILRB5
  Gene Name: leukocyte immunoglobulin-like receptor, subfamily B (with TM and ITIM domains), member 5
  ENSP ID: ENSP00000481933
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQ

SEQ ID NO: 46287 - protein, 590 aa, Homo sapiens; identical to SEQ ID NO: 46276
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000482062

SEQ ID NO: 46288 - protein, 490 aa, Homo sapiens
  Payload ID: 9420
  Gene Symbol: LILRB5
  Gene Name: leukocyte immunoglobulin-like receptor, subfamily B (with TM and ITIM domains), member 5
  ENSP ID: ENSP00000482365
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 46289 - protein, 491 aa, Homo sapiens; identical to SEQ ID NO: 46278
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000482404

SEQ ID NO: 46290 - protein, 491 aa, Homo sapiens; identical to SEQ ID NO: 46278
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000482535

SEQ ID NO: 46291 - protein, 590 aa, Homo sapiens; identical to SEQ ID NO: 46276
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000483481

SEQ ID NO: 46292 - protein, 590 aa, Homo sapiens; identical to SEQ ID NO: 46276
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000483502

SEQ ID NO: 46293 - protein, 591 aa, Homo sapiens; identical to SEQ ID NO: 46277
  Payload ID: 9420
  Gene Symbol: LILRB5
  Gene Name: leukocyte immunoglobulin-like receptor, subfamily B (with TM and ITIM domains), member 5
  Uniprot ID: O75023
  ENSP ID: ENSP00000483649

SEQ ID NO: 46294 - protein, 643 aa, Homo sapiens
  Payload ID: 9420
  Gene Symbol: LILRB5
  Gene Name: leukocyte immunoglobulin-like receptor, subfamily B (with TM and ITIM domains), member 5
  ENSP ID: ENSP00000483942
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARQSPHDEDPQAVTYAEVKHSRPRREMASPPSPLSGEFLDTKDRQAEEDRQMDTEAAASEAPQDVTYAQLHSLTLRREATEPPPSQEREPPAEPSIYAPLAIH

SEQ ID NO: 46295 - protein, 264 aa, Homo sapiens
  Payload ID: 9421
  Gene Symbol: LENG1
  Gene Name: leukocyte receptor cluster (LRC) member 1
  Uniprot ID: Q96BZ8
  ENSP ID: ENSP00000222224
MNILPKKSWHVRNKDNVARVRRDEAQAREEEKERERRVLLAQQEARTEFLRKKARHQNSLPELEAAEAGAPGSGPVDLFRELLEEGKGVIRGNKEYKEEKRQEKERQEKALGILTYLGQSAAEAQTQPPWYQLPPGRGGPPPGPAPDEKIKSRLDPLREMQKHLGKKRQHGGDEGSRSRKEKEGSEKQRPKEPPSLDQLRAERLRREAAERSRAEALLARVQGRALQEGQPEEDETDDRRRRYNSQFNPQLARRPRQQDPHLTH

SEQ ID NO: 46296 - protein, 264 aa, Homo sapiens
  Payload ID: 9421
  Gene Symbol: LENG1
  Gene Name: leukocyte receptor cluster (LRC) member 1
  ENSP ID: ENSP00000477607
MNILPKKSWHVRNKDNVARVRRDEAQAREEEKERERRVLLAQQEARTEFLRKKARHQNSLPELEAAEAGAPGSGPVDLFRELLEEGKGVIRGNKEYEEEKRQEKERQEKALGILTYLGQSAAEAQTQPPWYQLPPGRGGPPPGPAPDEKIKSRLDPLREMQKHLGKKRQHGGDEGSRSRKEKEGSEKQRPKEPPSLDQLRAERLRREAAERSRAEALLARVQGRALQEGQPEEDETDDRRRRYNSQFNPQLARRPRQQDPHLTH

SEQ ID NO: 46297 - protein, 264 aa, Homo sapiens; identical to SEQ ID NO: 46296
  Payload ID: 9421
  Gene Symbol: LENG1
  Gene Name: leukocyte receptor cluster (LRC) member 1
  Uniprot ID: Q96BZ8
  ENSP ID: ENSP00000478485

SEQ ID NO: 46298 - protein, 264 aa, Homo sapiens; identical to SEQ ID NO: 46296
  Payload ID: 9421
  Gene Symbol: LENG1
  Gene Name: leukocyte receptor cluster (LRC) member 1
  ENSP ID: ENSP00000479538

SEQ ID NO: 46299 - protein, 264 aa, Homo sapiens; identical to SEQ ID NO: 46296
  Payload ID: 9421
  Gene Symbol: LENG1
  Gene Name: leukocyte receptor cluster (LRC) member 1
  ENSP ID: ENSP00000480516

SEQ ID NO: 46300 - protein, 264 aa, Homo sapiens; identical to SEQ ID NO: 46296
  Payload ID: 9421
  Gene Symbol: LENG1
  Gene Name: leukocyte receptor cluster (LRC) member 1
  ENSP ID: ENSP00000481079

SEQ ID NO: 46301 - protein, 264 aa, Homo sapiens; identical to SEQ ID NO: 46296
  Payload ID: 9421
  Gene Symbol: LENG1
  Gene Name: leukocyte receptor cluster (LRC) member 1
  Uniprot ID: Q96BZ8
  ENSP ID: ENSP00000481252

SEQ ID NO: 46302 - protein, 264 aa, Homo sapiens; identical to SEQ ID NO: 46296
  Payload ID: 9421
  Gene Symbol: LENG1
  Gene Name: leukocyte receptor cluster (LRC) member 1
  Uniprot ID: Q96BZ8
  ENSP ID: ENSP00000481386

SEQ ID NO: 46303 - protein, 264 aa, Homo sapiens; identical to SEQ ID NO: 46296
  Payload ID: 9421
  Gene Symbol: LENG1
  Gene Name: leukocyte receptor cluster (LRC) member 1
  Uniprot ID: Q96BZ8
  ENSP ID: ENSP00000481948

SEQ ID NO: 46304 - protein, 264 aa, Homo sapiens; identical to SEQ ID NO: 46296
  Payload ID: 9421
  Gene Symbol: LENG1
  Gene Name: leukocyte receptor cluster (LRC) member 1
  ENSP ID: ENSP00000483164

SEQ ID NO: 46305 - protein, 800 aa, Homo sapiens
  Payload ID: 9422
  Gene Symbol: LENG8
  Gene Name: leukocyte receptor cluster (LRC) member 8
  Uniprot ID: Q96PV6
  ENSP ID: ENSP00000318374
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTFRPALPVSYLQAELAFEGEAACRAFLEPLGLAYTGPDNSSIDCRLSLAQLSAF

SEQ ID NO: 46306 - protein, 837 aa, Homo sapiens
  Payload ID: 9422
  Gene Symbol: LENG8
  Gene Name: leukocyte receptor cluster (LRC) member 8
  ENSP ID: ENSP00000365697
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLAPPLRPAPGRRPPPAPNPCPGPCFPIIFLHSALPSPVPLALLVGHLCVPGHSSPSPHCSQLTASGASSPPHLCVSSSCSLLPGPPSSLLALGFLRTLRSLLSQLVAVLPP

SEQ ID NO: 46307 - protein, 91 aa, Homo sapiens
  Payload ID: 9422
  Gene Symbol: LENG8
  Gene Name: leukocyte receptor cluster (LRC) member 8
  ENSP ID: ENSP00000390010
MAANVGDQRSTDWSSQYSMVAGAGRENGMETPMHENPEWEKARQALASISKSGAAGGSAKSSSNGPVASAQYVSQAEASALQQQQYYQWYQ

SEQ ID NO: 46308 - protein, 111 aa, Homo sapiens
  Payload ID: 9422
  Gene Symbol: LENG8
  Gene Name: leukocyte receptor cluster (LRC) member 8
  ENSP ID: ENSP00000390612
HRFFRLYCHAPCMSGYLVDKFADRERKVALKAMIKTVFSLSLSSLHSGTRPGALAHPMPGGQWKEDRPSSPCPPAAGAPSKPAHRPLPHLLRHRLLFPAPWGLRVWGGGAA

SEQ ID NO: 46309 - protein, 300 aa, Homo sapiens
  Payload ID: 9422
  Gene Symbol: LENG8
  Gene Name: leukocyte receptor cluster (LRC) member 8
  ENSP ID: ENSP00000399507
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERC

SEQ ID NO: 46310 - protein, 75 aa, Homo sapiens
  Payload ID: 9422
  Gene Symbol: LENG8
  Gene Name: leukocyte receptor cluster (LRC) member 8
  ENSP ID: ENSP00000412780
MVAGAGRENGMETPMHENPEWEKARQALASISKSGAAGGSAKSSSNGPVASAQYVSQAEASALQQQQYYQWYQQY

SEQ ID NO: 46311 - protein, 781 aa, Homo sapiens
  Payload ID: 9422
  Gene Symbol: LENG8
  Gene Name: leukocyte receptor cluster (LRC) member 8
  ENSP ID: ENSP00000477813
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLVSSCIKLSPCPLLPLPPVFLLIFFSPFPPSLSAFFPWFSTGKTVPPSLPPSSAM

SEQ ID NO: 46312 - protein, 91 aa, Homo sapiens; identical to SEQ ID NO: 46307
  Payload ID: 9422
  Gene Symbol: LENG8
  Gene Name: leukocyte receptor cluster (LRC) member 8
  ENSP ID: ENSP00000478323

SEQ ID NO: 46313 - protein, 800 aa, Homo sapiens; identical to SEQ ID NO: 46305
  Payload ID: 9422
  Gene Symbol: LENG8
  Gene Name: leukocyte receptor cluster (LRC) member 8
  Uniprot ID: Q96PV6
  ENSP ID: ENSP00000478337

SEQ ID NO: 46314 - protein, 874 aa, Homo sapiens
  Payload ID: 9422
  Gene Symbol: LENG8
  Gene Name: leukocyte receptor cluster (LRC) member 8
  ENSP ID: ENSP00000478590
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLAPPLRPAPGRRPPPAPNPCPGPCFPIIFLHSALPSPVPLALLVGHLCVPGHSSPSPHCSQLTASGASSPPHLCVSSSCSLLPGPPSSLLALGFLRTLRSLLSQLVAVLPP

SEQ ID NO: 46315 - protein, 800 aa, Homo sapiens; identical to SEQ ID NO: 46305
  Payload ID: 9422
  Gene Symbol: LENG8
  Gene Name: leukocyte receptor cluster (LRC) member 8
  Uniprot ID: Q96PV6
  ENSP ID: ENSP00000478975

SEQ ID NO: 46316 - protein, 781 aa, Homo sapiens; identical to SEQ ID NO: 46311
  Payload ID: 9422
  Gene Symbol: LENG8
  Gene Name: leukocyte receptor cluster (LRC) member 8
  ENSP ID: ENSP00000479293

SEQ ID NO: 46317 - protein, 800 aa, Homo sapiens; identical to SEQ ID NO: 46305
  Payload ID: 9422
  Gene Symbol: LENG8
  Gene Name: leukocyte receptor cluster (LRC) member 8
  Uniprot ID: Q96PV6
  ENSP ID: ENSP00000480663

SEQ ID NO: 46318 - protein, 151 aa, Homo sapiens
  Payload ID: 9422
  Gene Symbol: LENG8
  Gene Name: leukocyte receptor cluster (LRC) member 8
  ENSP ID: ENSP00000480782
MVAGAGRENGMETPMHENPEWEKARQALASISKSGAAGGSAKSSSNGPVASAQYVSQAEASALQQQQYYQWYQQYNYAYPYSYYYPMPPVPGMDESMSYQAPPQQLPSAQPPQPSNPPHGAHTLNSGPQPGTAPATQHSQAGPATGQAYGP

SEQ ID NO: 46319 - protein, 91 aa, Homo sapiens; identical to SEQ ID NO: 46307
  Payload ID: 9422
  Gene Symbol: LENG8
  Gene Name: leukocyte receptor cluster (LRC) member 8
  ENSP ID: ENSP00000480833

SEQ ID NO: 46320 - protein, 781 aa, Homo sapiens; identical to SEQ ID NO: 46311
  Payload ID: 9422
  Gene Symbol: LENG8
  Gene Name: leukocyte receptor cluster (LRC) member 8
  ENSP ID: ENSP00000481040

SEQ ID NO: 46321 - protein, 726 aa, Homo sapiens
  Payload ID: 9422
  Gene Symbol: LENG8
  Gene Name: leukocyte receptor cluster (LRC) member 8
  ENSP ID: ENSP00000481462
  MOD_RES (1)..(1): Any amino acid
XESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLAPPLRPAPGRRPPPAPNPCPGPCFPIIFLHSALPSPVPLALLVGHLCVPGHSSPSPHCSQLTASGASSPPHLCVSSSCSLLPGPPSSLLALGFLRTLRSLLSQLVAVLPP

SEQ ID NO: 46322 - protein, 726 aa, Homo sapiens; identical to SEQ ID NO: 46321
  Payload ID: 9422
  Gene Symbol: LENG8
  Gene Name: leukocyte receptor cluster (LRC) member 8
  ENSP ID: ENSP00000481768
  MOD_RES (1)..(1): Any amino acid

SEQ ID NO: 46323 - protein, 726 aa, Homo sapiens; identical to SEQ ID NO: 46321
  Payload ID: 9422
  Gene Symbol: LENG8
  Gene Name: leukocyte receptor cluster (LRC) member 8
  ENSP ID: ENSP00000482405
  MOD_RES (1)..(1): Any amino acid

SEQ ID NO: 46324 - protein, 91 aa, Homo sapiens; identical to SEQ ID NO: 46307
  Payload ID: 9422
  Gene Symbol: LENG8
  Gene Name: leukocyte receptor cluster (LRC) member 8
  ENSP ID: ENSP00000482778

SEQ ID NO: 46325 - protein, 199 aa, Homo sapiens
  Payload ID: 9422
  Gene Symbol: LENG8
  Gene Name: leukocyte receptor cluster (LRC) member 8
  ENSP ID: ENSP00000484429
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPA

SEQ ID NO: 46326 - protein, 781 aa, Homo sapiens; identical to SEQ ID NO: 46311
  Payload ID: 9422
  Gene Symbol: LENG8
  Gene Name: leukocyte receptor cluster (LRC) member 8
  ENSP ID: ENSP00000484494

SEQ ID NO: 46327 - protein, 111 aa, Homo sapiens; identical to SEQ ID NO: 46308
  Payload ID: 9422
  Gene Symbol: LENG8
  Gene Name: leukocyte receptor cluster (LRC) member 8
  ENSP ID: ENSP00000484735

SEQ ID NO: 46328 - protein, 501 aa, Homo sapiens
  Payload ID: 9423
  Gene Symbol: LENG9
  Gene Name: leukocyte receptor cluster (LRC) member 9
  Uniprot ID: Q96B70
  ENSP ID: ENSP00000477636
MGSRPPCGATSSARRACQFPAPMAAAREPELPQEAPATEPAPPPACRFFLEGRCRFGARCRQPHPGAPAPPGREAQPEAGAKKPPLRTAADVIQRIRWDPRLDPADFSVGYVDRFLGVREEPFSAFCWDQPLAALGPGVLAVPQHRVRFFRFHGRLVWDRASRTDLVFGSGSAAGRGPTILDAPNTEGAHGAEGAEWTLAGTGQEAQAAPKRGSTRPLCTGHQEPGVEEPGELEAAQERALGTAADLGTLAPRGRLAGVTEEALKPTAATRTTLLGGKEAQALGVPGGSAETTEAEWGPAAWPEDKRARLSVAAPCQPRPTHFVALMVTEPGLQAEVTKAQEYLVHVAPHCANFLVPSQNLHLTLALLRLAGAGEEAAAIGALRRALLAPGLNAPPRLSFRKLVLLGPHVLCAPPSPTLESMAQVLSQRLEAEGLSTLQSPGQLHPHLTVAKVPHGSQVHLPKLEFTLSQEVGCQPLQTLWLCRIGRTGGPFQPLAEIRLE

SEQ ID NO: 46329 - protein, 478 aa, Homo sapiens
  Payload ID: 9423
  Gene Symbol: LENG9
  Gene Name: leukocyte receptor cluster (LRC) member 9
  ENSP ID: ENSP00000478498
MAAAREPELPQEAPATEPAPPPACRFFLEGRCRFGARCRQPHPGAPAPPGREAQPEAGAKKPPLRTAADVIQRIRWDPRLDPADFSVGYVDRFLGVREEPFSAFCWDQPLAALGPGVLAVPQHRVRFFRFRGRLVWDRASRTDLVFGSGSAAGRGPTILDAPNTEGAHGAEGAEWTLAGTGQEAQAAPKRGSTRPLCTGHQEPGVEEPGELEAAQERALGTAADLGTLAPRGRLAGVTEALKPTAATRTTLLGGKEAQALGVPGGSAETTEAEWGPAAWPEDKRARLSVAAPCQPRPTHFVALMVTEPGLQAEVTKAQEYLVHVAPHCANFLVPSQNLHLTLALLRLAGAGEEAAAIGALRRALLAPGLNAPPRLSFRKLVLLGPHVLCAPPSPTLESMAQVLSQRLEAEGLSTLQSPGQLHPHLTVAKVPHGSQVHLPKLEFTLSQEVGCQPLQTLWLCRIGRTGGPFQPLAEIPLE

SEQ ID NO: 46330 - protein, 478 aa, Homo sapiens; identical to SEQ ID NO: 46329
  Payload ID: 9423
  Gene Symbol: LENG9
  Gene Name: leukocyte receptor cluster (LRC) member 9
  ENSP ID: ENSP00000479355

SEQ ID NO: 46331 - protein, 501 aa, Homo sapiens; identical to SEQ ID NO: 46328
  Payload ID: 9423
  Gene Symbol: LENG9
  Gene Name: leukocyte receptor cluster (LRC) member 9
  Uniprot ID: Q96B70
  ENSP ID: ENSP00000483600

SEQ ID NO: 46332 - protein, 864 aa, Homo sapiens
  Payload ID: 9424
  Gene Symbol: LTK
  Gene Name: leukocyte receptor tyrosine kinase
  Uniprot ID: P29376
  ENSP ID: ENSP00000263800
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 46333 - protein, 803 aa, Homo sapiens
  Payload ID: 9424
  Gene Symbol: LTK
  Gene Name: leukocyte receptor tyrosine kinase
  Uniprot ID: P29376
  ENSP ID: ENSP00000347293
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 46334 - protein, 734 aa, Homo sapiens
  Payload ID: 9424
  Gene Symbol: LTK
  Gene Name: leukocyte receptor tyrosine kinase
  Uniprot ID: P29376
  ENSP ID: ENSP00000392196
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGGAWPGPVLASATRCHRGFPSQCYSAQTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 46335 - protein, 562 aa, Homo sapiens
  Payload ID: 9424
  Gene Symbol: LTK
  Gene Name: leukocyte receptor tyrosine kinase
  ENSP ID: ENSP00000458111
MGCWGQLLVWFGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGTKRLAGTVDSRLLLSMKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 46336 - protein, 28 aa, Homo sapiens
  Payload ID: 9425
  Gene Symbol: LST1
  Gene Name: leukocyte specific transcript 1
  ENSP ID: ENSP00000211921
MLSRNDGPGLLRAGTPLCISAEAASAQQ

SEQ ID NO: 46337 - protein, 59 aa, Homo sapiens
  Payload ID: 9425
  Gene Symbol: LST1
  Gene Name: leukocyte specific transcript 1
  Uniprot ID: O00453
  ENSP ID: ENSP00000303649
MLSRNDDICIYGGLGLGGLLLLAVVLLSACLCWLHRRGPGLLRAGTPLCISAEAASAQQ

SEQ ID NO: 46338 - protein, 66 aa, Homo sapiens
  Payload ID: 9425
  Gene Symbol: LST1
  Gene Name: leukocyte specific transcript 1
  Uniprot ID: O00453
  ENSP ID: ENSP00000339201
MLSRNDDICIYGGLGLGGLLLLAVVLLSACLCWLHRRAPSVLVPGPGLLRAGTPLCISAEAASAQQ

SEQ ID NO: 46339 - protein, 73 aa, Homo sapiens
  Payload ID: 9425
  Gene Symbol: LST1
  Gene Name: leukocyte specific transcript 1
  Uniprot ID: O00453
  ENSP ID: ENSP00000365254
MLSRNDVKRLERSWHLLSWSQAQGSSEQELHYASLQRLPVPSSEGPDLRGRDKRGTKEDPRADYACIAENKPT

SEQ ID NO: 46340 - protein, 66 aa, Homo sapiens
  Payload ID: 9425
  Gene Symbol: LST1
  Gene Name: leukocyte specific transcript 1
  Uniprot ID: O00453
  ENSP ID: ENSP00000365257
MLSRNDVKRLERSWAQGSSEQELHYASLQRLPVPSSEGPDLRGRDKRGTKEDPRADYACIAENKPT

SEQ ID NO: 46341 - protein, 28 aa, Homo sapiens
  Payload ID: 9425
  Gene Symbol: LST1
  Gene Name: leukocyte specific transcript 1
  ENSP ID: ENSP00000365258
MLSRNDGPGLLRAGTPLCISAEAASAQQ

SEQ ID NO: 46342 - protein, 35 aa, Homo sapiens
  Payload ID: 9425
  Gene Symbol: LST1
  Gene Name: leukocyte specific transcript 1
  Uniprot ID: O00453
  ENSP ID: ENSP00000365260
MLSRNDAPSVLVPGPGLLRAGTPLCISAEAASAQQ

SEQ ID NO: 46343 - protein, 104 aa, Homo sapiens
  Payload ID: 9425
  Gene Symbol: LST1
  Gene Name: leukocyte specific transcript 1
  Uniprot ID: O00453
  ENSP ID: ENSP00000365261
MLSRNDDICIYGGLGLGGLLLLAVVLLSACLCWLHRRVKRLERSWHLLSWSQAQGSSEQELHYASLQRLPVPSSEGPDLRGRDKRGTKEDPRADYACIAENKPT

SEQ ID NO: 46344 - protein, 13 aa, Homo sapiens
  Payload ID: 9425
  Gene Symbol: LST1
  Gene Name: leukocyte specific transcript 1
  Uniprot ID: O00453
  ENSP ID: ENSP00000365264
MLSRNDEAASAQQ

SEQ ID NO: 46345 - protein, 28 aa, Homo sapiens
  Payload ID: 9425
  Gene Symbol: LST1
  Gene Name: leukocyte specific transcript 1
  ENSP ID: ENSP00000365267
MLSRNDGPGLLRAGTPLCISAEAASAQQ

SEQ ID NO: 46346 - protein, 51 aa, Homo sapiens
  Payload ID: 9425
  Gene Symbol: LST1
  Gene Name: leukocyte specific transcript 1
  Uniprot ID: O00453
  ENSP ID: ENSP00000365278
MLSRNDVKRLERSWRLPVPSSEGPDLRGRDKRGTKEDPRADYACIAENKPT

SEQ ID NO: 46347 - protein, 73 aa, Homo sapiens; identical to SEQ ID NO: 46339
  Payload ID: 9425
  Gene Symbol: LST1
  Gene Name: leukocyte specific transcript 1
  Uniprot ID: O00453
  ENSP ID: ENSP00000372972

SEQ ID NO: 46348 - protein, 35 aa, Homo sapiens; identical to SEQ ID NO: 46342
  Payload ID: 9425
  Gene Symbol: LST1
  Gene Name: leukocyte specific transcript 1
  Uniprot ID: O00453
  ENSP ID: ENSP00000372974

SEQ ID NO: 46349 - protein, 66 aa, Homo sapiens; identical to SEQ ID NO: 46338
  Payload ID: 9425
  Gene Symbol: LST1
  Gene Name: leukocyte specific transcript 1
  Uniprot ID: O00453
  ENSP ID: ENSP00000372976

SEQ ID NO: 46350 - protein, 104 aa, Homo sapiens; identical to SEQ ID NO: 46343
  Payload ID: 9425
  Gene Symbol: LST1
  Gene Name: leukocyte specific transcript 1
  Uniprot ID: O00453
  ENSP ID: ENSP00000372978

SEQ ID NO: 46351 - protein, 44 aa, Homo sapiens
  Payload ID: 9425
  Gene Symbol: LST1
  Gene Name: leukocyte specific transcript 1
  ENSP ID: ENSP00000379408
MLSRNDDICIYGGLGLGGLLLLAVVLLSACLCWLHRREAASAQQ

SEQ ID NO: 46352 - protein, 66 aa, Homo sapiens
  Payload ID: 9425
  Gene Symbol: LST1
  Gene Name: leukocyte specific transcript 1
  ENSP ID: ENSP00000379418
MLSRNDDICIYGGLGLGGLLLLAVVLLSACLCWLHRRVKRLERSWRLPVPSSEGPDLRGRDKRGTK

SEQ ID NO: 46353 - protein, 59 aa, Homo sapiens; identical to SEQ ID NO: 46337
  Payload ID: 9425
  Gene Symbol: LST1
  Gene Name: leukocyte specific transcript 1
  Uniprot ID: O00453
  ENSP ID: ENSP00000383109

SEQ ID NO: 46354 - protein, 28 aa, Homo sapiens
  Payload ID: 9425
  Gene Symbol: LST1
  Gene Name: leukocyte specific transcript 1
  ENSP ID: ENSP00000383110
MLSRNDGPGLLRAGTPLCISAEAASAQQ

SEQ ID NO: 46355 - protein, 28 aa, Homo sapiens
  Payload ID: 9425
  Gene Symbol: LST1
  Gene Name: leukocyte specific transcript 1
  ENSP ID: ENSP00000383111
MLSRNDGPGLLRAGTPLCISAEAASAQQ

SEQ ID NO: 46356 - protein, 28 aa, Homo sapiens
  Payload ID: 9425
  Gene Symbol: LST1
  Gene Name: leukocyte specific transcript 1
  ENSP ID: ENSP00000383112
MLSRNDGPGLLRAGTPLCISAEAASAQQ

SEQ ID NO: 46357 - protein, 28 aa, Homo sapiens
  Payload ID: 9425
  Gene Symbol: LST1
  Gene Name: leukocyte specific transcript 1
  ENSP ID: ENSP00000383114
MLSRNDGPGLLRAGTPLCISAEAASAQQ

SEQ ID NO: 46358 - protein, 13 aa, Homo sapiens
  Payload ID: 9425
  Gene Symbol: LST1
  Gene Name: leukocyte specific transcript 1
  Uniprot ID: O00453
  ENSP ID: ENSP00000383116
MLSRNDEAASAQQ

SEQ ID NO: 46359 - protein, 82 aa, Homo sapiens
  Payload ID: 9425
  Gene Symbol: LST1
  Gene Name: leukocyte specific transcript 1
  ENSP ID: ENSP00000383120
MLSRNDDICIYGGLGLGGLLLLAVVLLSACLCWLHRRVKRLERSWRLPVPSSEGPDLRGRDKRGTKEDPRADYACIAENKPT

SEQ ID NO: 46360 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000383121

SEQ ID NO: 46361 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000383122

SEQ ID NO: 46362 - protein, 97 aa, Homo sapiens
  Payload ID: 9425
  Gene Symbol: LST1
  Gene Name: leukocyte specific transcript 1
  Uniprot ID: O00453
  ENSP ID: ENSP00000383123
MLSRNDDICIYGGLGLGGLLLLAVVLLSACLCWLHRRVKRLERSWAQGSSEQELHYASLQRLPVPSSEGPDLRGRDKRGTKEDPRADYACIAENKPT

SEQ ID NO: 46363 - protein, 51 aa, Homo sapiens; identical to SEQ ID NO: 46346
  Payload ID: 9425
  Gene Symbol: LST1
  Gene Name: leukocyte specific transcript 1
  Uniprot ID: O00453
  ENSP ID: ENSP00000383124

SEQ ID NO: 46364 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000387560

SEQ ID NO: 46365 - protein, 28 aa, Homo sapiens
  Payload ID: 9425
  Gene Symbol: LST1
  Gene Name: leukocyte specific transcript 1
  ENSP ID: ENSP00000387689
MLSRNDGPGLLRAGTPLCISAEAASAQQ

SEQ ID NO: 46366 - protein, 43 aa, Homo sapiens
  Payload ID: 9425
  Gene Symbol: LST1
  Gene Name: leukocyte specific transcript 1
  ENSP ID: ENSP00000387723
  MOD_RES (1)..(1): Any amino acid
XSRNDDICIYGGLGLGGLLLLAVVLLSACLCWLHRREAASAQQ

SEQ ID NO: 46367 - protein, 28 aa, Homo sapiens
  Payload ID: 9425
  Gene Symbol: LST1
  Gene Name: leukocyte specific transcript 1
  ENSP ID: ENSP00000388397
MLSRNDGPGLLRAGTPLCISAEAASAQQ

SEQ ID NO: 46368 - protein, 28 aa, Homo sapiens
  Payload ID: 9425
  Gene Symbol: LST1
  Gene Name: leukocyte specific transcript 1
  ENSP ID: ENSP00000388514
MLSRNDGPGLLRAGTPLCISAEAASAQQ

SEQ ID NO: 46369 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000388956

SEQ ID NO: 46370 - protein, 46 aa, Homo sapiens
  Payload ID: 9425
  Gene Symbol: LST1
  Gene Name: leukocyte specific transcript 1
  ENSP ID: ENSP00000389579
MLSRNDDICIYGGLGLGGLLLLAVVLLSACLCWLHRREHCLALEPL

SEQ ID NO: 46371 - protein, 13 aa, Homo sapiens
  Payload ID: 9425
  Gene Symbol: LST1
  Gene Name: leukocyte specific transcript 1
  Uniprot ID: O00453
  ENSP ID: ENSP00000389694
MLSRNDEAASAQQ

SEQ ID NO: 46372 - protein, 59 aa, Homo sapiens; identical to SEQ ID NO: 46337
  Payload ID: 9425
  Gene Symbol: LST1
  Gene Name: leukocyte specific transcript 1
  Uniprot ID: O00453
  ENSP ID: ENSP00000389795

SEQ ID NO: 46373 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000390430

SEQ ID NO: 46374 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000390587

SEQ ID NO: 46375 - protein, 35 aa, Homo sapiens; identical to SEQ ID NO: 46342
  Payload ID: 9425
  Gene Symbol: LST1
  Gene Name: leukocyte specific transcript 1
  Uniprot ID: O00453
  ENSP ID: ENSP00000390658

SEQ ID NO: 46376 - protein, 73 aa, Homo sapiens; identical to SEQ ID NO: 46339
  Payload ID: 9425
  Gene Symbol: LST1
  Gene Name: leukocyte specific transcript 1
  Uniprot ID: O00453
  ENSP ID: ENSP00000390885

SEQ ID NO: 46377 - protein, 51 aa, Homo sapiens; identical to SEQ ID NO: 46346
  Payload ID: 9425
  Gene Symbol: LST1
  Gene Name: leukocyte specific transcript 1
  Uniprot ID: O00453
  ENSP ID: ENSP00000391057

SEQ ID NO: 46378 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000391420

SEQ ID NO: 46379 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000391929

SEQ ID NO: 46380 - protein, 43 aa, Homo sapiens; identical to SEQ ID NO: 46366
  Payload ID: 9425
  Gene Symbol: LST1
  Gene Name: leukocyte specific transcript 1
  ENSP ID: ENSP00000391961
  MOD_RES (1)..(1): Any amino acid

SEQ ID NO: 46381 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000391963

SEQ ID NO: 46382 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000392949

SEQ ID NO: 46383 - protein, 43 aa, Homo sapiens; identical to SEQ ID NO: 46366
  Payload ID: 9425
  Gene Symbol: LST1
  Gene Name: leukocyte specific transcript 1
  ENSP ID: ENSP00000393046
  MOD_RES (1)..(1): Any amino acid

SEQ ID NO: 46384 - protein, 46 aa, Homo sapiens; identical to SEQ ID NO: 46370
  Payload ID: 9425
  Gene Symbol: LST1
  Gene Name: leukocyte specific transcript 1
  ENSP ID: ENSP00000393067

SEQ ID NO: 46385 - protein, 66 aa, Homo sapiens; identical to SEQ ID NO: 46338
  Payload ID: 9425
  Gene Symbol: LST1
  Gene Name: leukocyte specific transcript 1
  Uniprot ID: O00453
  ENSP ID: ENSP00000393282

SEQ ID NO: 46386 - protein, 66 aa, Homo sapiens; identical to SEQ ID NO: 46338
  Payload ID: 9425
  Gene Symbol: LST1
  Gene Name: leukocyte specific transcript 1
  Uniprot ID: O00453
  ENSP ID: ENSP00000393345

SEQ ID NO: 46387 - protein, 28 aa, Homo sapiens
  Payload ID: 9425
  Gene Symbol: LST1
  Gene Name: leukocyte specific transcript 1
  ENSP ID: ENSP00000393802
MLSRNDGPGLLRAGTPLCISAEAASAQQ

SEQ ID NO: 46388 - protein, 46 aa, Homo sapiens; identical to SEQ ID NO: 46370
  Payload ID: 9425
  Gene Symbol: LST1
  Gene Name: leukocyte specific transcript 1
  ENSP ID: ENSP00000393824

SEQ ID NO: 46389 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000394614

SEQ ID NO: 46390 - protein, 73 aa, Homo sapiens; identical to SEQ ID NO: 46339
  Payload ID: 9425
  Gene Symbol: LST1
  Gene Name: leukocyte specific transcript 1
  Uniprot ID: O00453
  ENSP ID: ENSP00000394815

SEQ ID NO: 46391 - protein, 35 aa, Homo sapiens; identical to SEQ ID NO: 46342
  Payload ID: 9425
  Gene Symbol: LST1
  Gene Name: leukocyte specific transcript 1
  Uniprot ID: O00453
  ENSP ID: ENSP00000394834

SEQ ID NO: 46392 - protein, 51 aa, Homo sapiens; identical to SEQ ID NO: 46346
  Payload ID: 9425
  Gene Symbol: LST1
  Gene Name: leukocyte specific transcript 1
  Uniprot ID: O00453
  ENSP ID: ENSP00000394891

SEQ ID NO: 46393 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000395409

SEQ ID NO: 46394 - protein, 46 aa, Homo sapiens; identical to SEQ ID NO: 46370
  Payload ID: 9425
  Gene Symbol: LST1
  Gene Name: leukocyte specific transcript 1
  ENSP ID: ENSP00000395652

SEQ ID NO: 46395 - protein, 36 aa, Homo sapiens
  Payload ID: 9425
  Gene Symbol: LST1
  Gene Name: leukocyte specific transcript 1
  ENSP ID: ENSP00000395821
MLSRNDDICIYGGLGLGGLLLLAVVLLSACLCWLHR

SEQ ID NO: 46396 - protein, 73 aa, Homo sapiens; identical to SEQ ID NO: 46339
  Payload ID: 9425
  Gene Symbol: LST1
  Gene Name: leukocyte specific transcript 1
  Uniprot ID: O00453
  ENSP ID: ENSP00000396004

SEQ ID NO: 46397 - protein, 104 aa, Homo sapiens; identical to SEQ ID NO: 46343
  Payload ID: 9425
  Gene Symbol: LST1
  Gene Name: leukocyte specific transcript 1
  Uniprot ID: O00453
  ENSP ID: ENSP00000396179

SEQ ID NO: 46398 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000396181

SEQ ID NO: 46399 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000396235

SEQ ID NO: 46400 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000396378

SEQ ID NO: 46401 - protein, 51 aa, Homo sapiens; identical to SEQ ID NO: 46346
  Payload ID: 9425
  Gene Symbol: LST1
  Gene Name: leukocyte specific transcript 1
  Uniprot ID: O00453
  ENSP ID: ENSP00000396431

SEQ ID NO: 46402 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000396533

SEQ ID NO: 46403 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000396579

SEQ ID NO: 46404 - protein, 13 aa, Homo sapiens
  Payload ID: 9425
  Gene Symbol: LST1
  Gene Name: leukocyte specific transcript 1
  Uniprot ID: O00453
  ENSP ID: ENSP00000397826
MLSRNDEAASAQQ

SEQ ID NO: 46405 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000398228

SEQ ID NO: 46406 - protein, 43 aa, Homo sapiens
  Payload ID: 9425
  Gene Symbol: LST1
  Gene Name: leukocyte specific transcript 1
  ENSP ID: ENSP00000398376
YRGMMIYVSTGAWGWAGSCFWQWSFCPPACVGCIEERLPVPSS

SEQ ID NO: 46407 - protein, 28 aa, Homo sapiens
  Payload ID: 9425
  Gene Symbol: LST1
  Gene Name: leukocyte specific transcript 1
  ENSP ID: ENSP00000398510
MLSRNDGPGLLRAGTPLCISAEAASAQQ

SEQ ID NO: 46408 - protein, 28 aa, Homo sapiens
  Payload ID: 9425
  Gene Symbol: LST1
  Gene Name: leukocyte specific transcript 1
  ENSP ID: ENSP00000398672
MLSRNDGPGLLRAGTPLCISAEAASAQQ

SEQ ID NO: 46409 - protein, 104 aa, Homo sapiens; identical to SEQ ID NO: 46343
  Payload ID: 9425
  Gene Symbol: LST1
  Gene Name: leukocyte specific transcript 1
  Uniprot ID: O00453
  ENSP ID: ENSP00000398685

SEQ ID NO: 46410 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000398700

SEQ ID NO: 46411 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000398780

SEQ ID NO: 46412 - protein, 66 aa, Homo sapiens; identical to SEQ ID NO: 46338
  Payload ID: 9425
  Gene Symbol: LST1
  Gene Name: leukocyte specific transcript 1
  Uniprot ID: O00453
  ENSP ID: ENSP00000398918

SEQ ID NO: 46413 - protein, 82 aa, Homo sapiens; identical to SEQ ID NO: 46359
  Payload ID: 9425
  Gene Symbol: LST1
  Gene Name: leukocyte specific transcript 1
  ENSP ID: ENSP00000399051

SEQ ID NO: 46414 - protein, 59 aa, Homo sapiens; identical to SEQ ID NO: 46337
  Payload ID: 9425
  Gene Symbol: LST1
  Gene Name: leukocyte specific transcript 1
  Uniprot ID: O00453
  ENSP ID: ENSP00000399063

SEQ ID NO: 46415 - protein, 28 aa, Homo sapiens
  Payload ID: 9425
  Gene Symbol: LST1
  Gene Name: leukocyte specific transcript 1
  ENSP ID: ENSP00000399180
MLSRNDGPGLLRAGTPLCISAEAASAQQ

SEQ ID NO: 46416 - protein, 43 aa, Homo sapiens; identical to SEQ ID NO: 46406
  Payload ID: 9425
  Gene Symbol: LST1
  Gene Name: leukocyte specific transcript 1
  ENSP ID: ENSP00000399203

SEQ ID NO: 46417 - protein, 104 aa, Homo sapiens; identical to SEQ ID NO: 46343
  Payload ID: 9425
  Gene Symbol: LST1
  Gene Name: leukocyte specific transcript 1
  Uniprot ID: O00453
  ENSP ID: ENSP00000399411

SEQ ID NO: 46418 - protein, 35 aa, Homo sapiens; identical to SEQ ID NO: 46342
  Payload ID: 9425
  Gene Symbol: LST1
  Gene Name: leukocyte specific transcript 1
  Uniprot ID: O00453
  ENSP ID: ENSP00000399439

SEQ ID NO: 46419 - protein, 66 aa, Homo sapiens; identical to SEQ ID NO: 46338
  Payload ID: 9425
  Gene Symbol: LST1
  Gene Name: leukocyte specific transcript 1
  Uniprot ID: O00453
  ENSP ID: ENSP00000399474

SEQ ID NO: 46420 - protein, 36 aa, Homo sapiens; identical to SEQ ID NO: 46395
  Payload ID: 9425
  Gene Symbol: LST1
  Gene Name: leukocyte specific transcript 1
  ENSP ID: ENSP00000399869

SEQ ID NO: 46421 - protein, 43 aa, Homo sapiens; identical to SEQ ID NO: 46366
  Payload ID: 9425
  Gene Symbol: LST1
  Gene Name: leukocyte specific transcript 1
  ENSP ID: ENSP00000399941
  MOD_RES (1)..(1): Any amino acid

SEQ ID NO: 46422 - protein, 51 aa, Homo sapiens; identical to SEQ ID NO: 46346
  Payload ID: 9425
  Gene Symbol: LST1
  Gene Name: leukocyte specific transcript 1
  Uniprot ID: O00453
  ENSP ID: ENSP00000400069

SEQ ID NO: 46423 - protein, 28 aa, Homo sapiens
  Payload ID: 9425
  Gene Symbol: LST1
  Gene Name: leukocyte specific transcript 1
  ENSP ID: ENSP00000400138
MLSRNDGPGLLRAGTPLCISAEAASAQQ

SEQ ID NO: 46424 - protein, 46 aa, Homo sapiens; identical to SEQ ID NO: 46370
  Payload ID: 9425
  Gene Symbol: LST1
  Gene Name: leukocyte specific transcript 1
  ENSP ID: ENSP00000400339

SEQ ID NO: 46425 - protein, 28 aa, Homo sapiens
  Payload ID: 9425
  Gene Symbol: LST1
  Gene Name: leukocyte specific transcript 1
  ENSP ID: ENSP00000400638
MLSRNDGPGLLRAGTPLCISAEAASAQQ

SEQ ID NO: 46426 - protein, 28 aa, Homo sapiens
  Payload ID: 9425
  Gene Symbol: LST1
  Gene Name: leukocyte specific transcript 1
  ENSP ID: ENSP00000400881
MLSRNDGPGLLRAGTPLCISAEAASAQQ

SEQ ID NO: 46427 - protein, 35 aa, Homo sapiens; identical to SEQ ID NO: 46342
  Payload ID: 9425
  Gene Symbol: LST1
  Gene Name: leukocyte specific transcript 1
  Uniprot ID: O00453
  ENSP ID: ENSP00000401516

SEQ ID NO: 46428 - protein, 73 aa, Homo sapiens; identical to SEQ ID NO: 46339
  Payload ID: 9425
  Gene Symbol: LST1
  Gene Name: leukocyte specific transcript 1
  Uniprot ID: O00453
  ENSP ID: ENSP00000401567

SEQ ID NO: 46429 - protein, 28 aa, Homo sapiens
  Payload ID: 9425
  Gene Symbol: LST1
  Gene Name: leukocyte specific transcript 1
  ENSP ID: ENSP00000401621
MLSRNDGPGLLRAGTPLCISAEAASAQQ

SEQ ID NO: 46430 - protein, 13 aa, Homo sapiens
  Payload ID: 9425
  Gene Symbol: LST1
  Gene Name: leukocyte specific transcript 1
  Uniprot ID: O00453
  ENSP ID: ENSP00000401650
MLSRNDEAASAQQ

SEQ ID NO: 46431 - protein, 13 aa, Homo sapiens
  Payload ID: 9425
  Gene Symbol: LST1
  Gene Name: leukocyte specific transcript 1
  Uniprot ID: O00453
  ENSP ID: ENSP00000401655
MLSRNDEAASAQQ

SEQ ID NO: 46432 - protein, 36 aa, Homo sapiens; identical to SEQ ID NO: 46395
  Payload ID: 9425
  Gene Symbol: LST1
  Gene Name: leukocyte specific transcript 1
  ENSP ID: ENSP00000402102

SEQ ID NO: 46433 - protein, 36 aa, Homo sapiens; identical to SEQ ID NO: 46395
  Payload ID: 9425
  Gene Symbol: LST1
  Gene Name: leukocyte specific transcript 1
  ENSP ID: ENSP00000402235

SEQ ID NO: 46434 - protein, 28 aa, Homo sapiens
  Payload ID: 9425
  Gene Symbol: LST1
  Gene Name: leukocyte specific transcript 1
  ENSP ID: ENSP00000402637
MLSRNDGPGLLRAGTPLCISAEAASAQQ

SEQ ID NO: 46435 - protein, 28 aa, Homo sapiens
  Payload ID: 9425
  Gene Symbol: LST1
  Gene Name: leukocyte specific transcript 1
  ENSP ID: ENSP00000402699
MLSRNDGPGLLRAGTPLCISAEAASAQQ

SEQ ID NO: 46436 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000402707

SEQ ID NO: 46437 - protein, 51 aa, Homo sapiens; identical to SEQ ID NO: 46346
  Payload ID: 9425
  Gene Symbol: LST1
  Gene Name: leukocyte specific transcript 1
  Uniprot ID: O00453
  ENSP ID: ENSP00000402873

SEQ ID NO: 46438 - protein, 28 aa, Homo sapiens
  Payload ID: 9425
  Gene Symbol: LST1
  Gene Name: leukocyte specific transcript 1
  ENSP ID: ENSP00000402960
MLSRNDGPGLLRAGTPLCISAEAASAQQ

SEQ ID NO: 46439 - protein, 104 aa, Homo sapiens; identical to SEQ ID NO: 46343
  Payload ID: 9425
  Gene Symbol: LST1
  Gene Name: leukocyte specific transcript 1
  Uniprot ID: O00453
  ENSP ID: ENSP00000403097

SEQ ID NO: 46440 - protein, 82 aa, Homo sapiens; identical to SEQ ID NO: 46359
  Payload ID: 9425
  Gene Symbol: LST1
  Gene Name: leukocyte specific transcript 1
  ENSP ID: ENSP00000403468

SEQ ID NO: 46441 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000404051

SEQ ID NO: 46442 - protein, 73 aa, Homo sapiens; identical to SEQ ID NO: 46339
  Payload ID: 9425
  Gene Symbol: LST1
  Gene Name: leukocyte specific transcript 1
  Uniprot ID: O00453
  ENSP ID: ENSP00000404500

SEQ ID NO: 46443 - protein, 28 aa, Homo sapiens
  Payload ID: 9425
  Gene Symbol: LST1
  Gene Name: leukocyte specific transcript 1
  ENSP ID: ENSP00000404870
MLSRNDGPGLLRAGTPLCISAEAASAQQ

SEQ ID NO: 46444 - protein, 28 aa, Homo sapiens
  Payload ID: 9425
  Gene Symbol: LST1
  Gene Name: leukocyte specific transcript 1
  ENSP ID: ENSP00000405433
MLSRNDGPGLLRAGTPLCISAEAASAQQ

SEQ ID NO: 46445 - protein, 46 aa, Homo sapiens; identical to SEQ ID NO: 46370
  Payload ID: 9425
  Gene Symbol: LST1
  Gene Name: leukocyte specific transcript 1
  ENSP ID: ENSP00000405869

SEQ ID NO: 46446 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000405900

SEQ ID NO: 46447 - protein, 13 aa, Homo sapiens
  Payload ID: 9425
  Gene Symbol: LST1
  Gene Name: leukocyte specific transcript 1
  Uniprot ID: O00453
  ENSP ID: ENSP00000405920
MLSRNDEAASAQQ

SEQ ID NO: 46448 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000406438

SEQ ID NO: 46449 - protein, 104 aa, Homo sapiens; identical to SEQ ID NO: 46343
  Payload ID: 9425
  Gene Symbol: LST1
  Gene Name: leukocyte specific transcript 1
  Uniprot ID: O00453
  ENSP ID: ENSP00000406455

SEQ ID NO: 46450 - protein, 66 aa, Homo sapiens; identical to SEQ ID NO: 46338
  Payload ID: 9425
  Gene Symbol: LST1
  Gene Name: leukocyte specific transcript 1
  Uniprot ID: O00453
  ENSP ID: ENSP00000406625

SEQ ID NO: 46451 - protein, 46 aa, Homo sapiens; identical to SEQ ID NO: 46370
  Payload ID: 9425
  Gene Symbol: LST1
  Gene Name: leukocyte specific transcript 1
  ENSP ID: ENSP00000407149

SEQ ID NO: 46452 - protein, 36 aa, Homo sapiens; identical to SEQ ID NO: 46395
  Payload ID: 9425
  Gene Symbol: LST1
  Gene Name: leukocyte specific transcript 1
  ENSP ID: ENSP00000407209

SEQ ID NO: 46453 - protein, 35 aa, Homo sapiens; identical to SEQ ID NO: 46342
  Payload ID: 9425
  Gene Symbol: LST1
  Gene Name: leukocyte specific transcript 1
  Uniprot ID: O00453
  ENSP ID: ENSP00000407417

SEQ ID NO: 46454 - protein, 36 aa, Homo sapiens; identical to SEQ ID NO: 46395
  Payload ID: 9425
  Gene Symbol: LST1
  Gene Name: leukocyte specific transcript 1
  ENSP ID: ENSP00000407449

SEQ ID NO: 46455 - protein, 82 aa, Homo sapiens; identical to SEQ ID NO: 46359
  Payload ID: 9425
  Gene Symbol: LST1
  Gene Name: leukocyte specific transcript 1
  ENSP ID: ENSP00000407534

SEQ ID NO: 46456 - protein, 82 aa, Homo sapiens; identical to SEQ ID NO: 46359
  Payload ID: 9425
  Gene Symbol: LST1
  Gene Name: leukocyte specific transcript 1
  ENSP ID: ENSP00000407803

SEQ ID NO: 46457 - protein, 82 aa, Homo sapiens; identical to SEQ ID NO: 46359
  Payload ID: 9425
  Gene Symbol: LST1
  Gene Name: leukocyte specific transcript 1
  ENSP ID: ENSP00000407824

SEQ ID NO: 46458 - protein, 13 aa, Homo sapiens
  Payload ID: 9425
  Gene Symbol: LST1
  Gene Name: leukocyte specific transcript 1
  Uniprot ID: O00453
  ENSP ID: ENSP00000408876
MLSRNDEAASAQQ

SEQ ID NO: 46459 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000409008

SEQ ID NO: 46460 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000409163

SEQ ID NO: 46461 - protein, 104 aa, Homo sapiens; identical to SEQ ID NO: 46343
  Payload ID: 9425
  Gene Symbol: LST1
  Gene Name: leukocyte specific transcript 1
  Uniprot ID: O00453
  ENSP ID: ENSP00000409229

SEQ ID NO: 46462 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000409433

SEQ ID NO: 46463 - protein, 35 aa, Homo sapiens; identical to SEQ ID NO: 46342
  Payload ID: 9425
  Gene Symbol: LST1
  Gene Name: leukocyte specific transcript 1
  Uniprot ID: O00453
  ENSP ID: ENSP00000409698

SEQ ID NO: 46464 - protein, 36 aa, Homo sapiens; identical to SEQ ID NO: 46395
  Payload ID: 9425
  Gene Symbol: LST1
  Gene Name: leukocyte specific transcript 1
  ENSP ID: ENSP00000410543

SEQ ID NO: 46465 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000411087

SEQ ID NO: 46466 - protein, 36 aa, Homo sapiens; identical to SEQ ID NO: 46395
  Payload ID: 9425
  Gene Symbol: LST1
  Gene Name: leukocyte specific transcript 1
  ENSP ID: ENSP00000411296

SEQ ID NO: 46467 - protein, 28 aa, Homo sapiens
  Payload ID: 9425
  Gene Symbol: LST1
  Gene Name: leukocyte specific transcript 1
  ENSP ID: ENSP00000411403
MLSRNDGPGLLRAGTPLCISAEAASAQQ

SEQ ID NO: 46468 - protein, 59 aa, Homo sapiens; identical to SEQ ID NO: 46337
  Payload ID: 9425
  Gene Symbol: LST1
  Gene Name: leukocyte specific transcript 1
  Uniprot ID: O00453
  ENSP ID: ENSP00000411547

SEQ ID NO: 46469 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000411866

SEQ ID NO: 46470 - protein, 59 aa, Homo sapiens; identical to SEQ ID NO: 46337
  Payload ID: 9425
  Gene Symbol: LST1
  Gene Name: leukocyte specific transcript 1
  Uniprot ID: O00453
  ENSP ID: ENSP00000411961

SEQ ID NO: 46471 - protein, 28 aa, Homo sapiens
  Payload ID: 9425
  Gene Symbol: LST1
  Gene Name: leukocyte specific transcript 1
  ENSP ID: ENSP00000412112
MLSRNDGPGLLRAGTPLCISAEAASAQQ

SEQ ID NO: 46472 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000412276

SEQ ID NO: 46473 - protein, 59 aa, Homo sapiens; identical to SEQ ID NO: 46337
  Payload ID: 9425
  Gene Symbol: LST1
  Gene Name: leukocyte specific transcript 1
  Uniprot ID: O00453
  ENSP ID: ENSP00000412627

SEQ ID NO: 46474 - protein, 28 aa, Homo sapiens
  Payload ID: 9425
  Gene Symbol: LST1
  Gene Name: leukocyte specific transcript 1
  ENSP ID: ENSP00000412978
MLSRNDGPGLLRAGTPLCISAEAASAQQ

SEQ ID NO: 46475 - protein, 28 aa, Homo sapiens
  Payload ID: 9425
  Gene Symbol: LST1
  Gene Name: leukocyte specific transcript 1
  ENSP ID: ENSP00000413488
MLSRNDGPGLLRAGTPLCISAEAASAQQ

SEQ ID NO: 46476 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000413526

SEQ ID NO: 46477 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000414173

SEQ ID NO: 46478 - protein, 73 aa, Homo sapiens; identical to SEQ ID NO: 46339
  Payload ID: 9425
  Gene Symbol: LST1
  Gene Name: leukocyte specific transcript 1
  Uniprot ID: O00453
  ENSP ID: ENSP00000414246

SEQ ID NO: 46479 - protein, 82 aa, Homo sapiens; identical to SEQ ID NO: 46359
  Payload ID: 9425
  Gene Symbol: LST1
  Gene Name: leukocyte specific transcript 1
  ENSP ID: ENSP00000414636

SEQ ID NO: 46480 - protein, 43 aa, Homo sapiens; identical to SEQ ID NO: 46366
  Payload ID: 9425
  Gene Symbol: LST1
  Gene Name: leukocyte specific transcript 1
  ENSP ID: ENSP00000414728
  MOD_RES (1)..(1): Any amino acid

SEQ ID NO: 46481 - protein, 28 aa, Homo sapiens
  Payload ID: 9425
  Gene Symbol: LST1
  Gene Name: leukocyte specific transcript 1
  ENSP ID: ENSP00000414729
MLSRNDGPGLLRAGTPLCISAEAASAQQ

SEQ ID NO: 46482 - protein, 28 aa, Homo sapiens
  Payload ID: 9425
  Gene Symbol: LST1
  Gene Name: leukocyte specific transcript 1
  ENSP ID: ENSP00000414738
MLSRNDGPGLLRAGTPLCISAEAASAQQ

SEQ ID NO: 46483 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000414744

SEQ ID NO: 46484 - protein, 51 aa, Homo sapiens; identical to SEQ ID NO: 46346
  Payload ID: 9425
  Gene Symbol: LST1
  Gene Name: leukocyte specific transcript 1
  Uniprot ID: O00453
  ENSP ID: ENSP00000415143

SEQ ID NO: 46485 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000415168

SEQ ID NO: 46486 - protein, 28 aa, Homo sapiens
  Payload ID: 9425
  Gene Symbol: LST1
  Gene Name: leukocyte specific transcript 1
  ENSP ID: ENSP00000415445
MLSRNDGPGLLRAGTPLCISAEAASAQQ

SEQ ID NO: 46487 - protein, 66 aa, Homo sapiens; identical to SEQ ID NO: 46340
  Payload ID: 9425
  Gene Symbol: LST1
  Gene Name: leukocyte specific transcript 1
  Uniprot ID: O00453
  ENSP ID: ENSP00000415526

SEQ ID NO: 46488 - protein, 59 aa, Homo sapiens; identical to SEQ ID NO: 46337
  Payload ID: 9425
  Gene Symbol: LST1
  Gene Name: leukocyte specific transcript 1
  Uniprot ID: O00453
  ENSP ID: ENSP00000415623

SEQ ID NO: 46489 - protein, 28 aa, Homo sapiens
  Payload ID: 9425
  Gene Symbol: LST1
  Gene Name: leukocyte specific transcript 1
  ENSP ID: ENSP00000416118
MLSRNDGPGLLRAGTPLCISAEAASAQQ

SEQ ID NO: 46490 - protein, 97 aa, Homo sapiens; identical to SEQ ID NO: 46362
  Payload ID: 9425
  Gene Symbol: LST1
  Gene Name: leukocyte specific transcript 1
  Uniprot ID: O00453
  ENSP ID: ENSP00000416283

SEQ ID NO: 46491 - protein, 66 aa, Homo sapiens; identical to SEQ ID NO: 46338
  Payload ID: 9425
  Gene Symbol: LST1
  Gene Name: leukocyte specific transcript 1
  Uniprot ID: O00453
  ENSP ID: ENSP00000416808

SEQ ID NO: 46492 - protein, 35 aa, Homo sapiens
  Payload ID: 9425
  Gene Symbol: LST1
  Gene Name: leukocyte specific transcript 1
  ENSP ID: ENSP00000417645
  MOD_RES (1)..(1): Any amino acid
XGGLLLLAVVLLSACLCWLHRREAGEELEAASAQQ

SEQ ID NO: 46493 - protein, 60 aa, Homo sapiens
  Payload ID: 9425
  Gene Symbol: LST1
  Gene Name: leukocyte specific transcript 1
  ENSP ID: ENSP00000418578
  MOD_RES (1)..(1): Any amino acid
XDICIYGGLGLGGLLLLAVVLLSACLCWLHRREAGEELGPGLLRAGTPLCISAEAASAQQ

SEQ ID NO: 46494 - protein, 270 aa, Homo sapiens
  Payload ID: 9426
  Gene Symbol: LAIR1
  Gene Name: leukocyte-associated immunoglobulin-like receptor 1
  Uniprot ID: Q6GTX8
  ENSP ID: ENSP00000301193
MSPHPTALLGLVLCLAQTIHTQEEDLPRPSISAEPGTVIPLGSHVTFVCRGPVGVQTFRLERDSRSTYNDTEDVSQASPSESEARFRIDSVREGNAGLYRCIYYKPPKWSEQSDYLELLVKGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46495 - protein, 280 aa, Homo sapiens
  Payload ID: 9426
  Gene Symbol: LAIR1
  Gene Name: leukocyte-associated immunoglobulin-like receptor 1
  ENSP ID: ENSP00000319204
MEREMVLCLAQTIHTQEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46496 - protein, 127 aa, Homo sapiens
  Payload ID: 9426
  Gene Symbol: LAIR1
  Gene Name: leukocyte-associated immunoglobulin-like receptor 1
  ENSP ID: ENSP00000375621
MSPHPTALLGLVLCLAQTIHTQEEDLPRPSISAEPGTVIPLGSHVTFVCRGPVGVQTFRLERDSRSTYNDTEDVSQASPSESEARFRIDSKALEARTPRTQSPAPQLDPRRGRRTTVTMSMHLLPKA

SEQ ID NO: 46497 - protein, 287 aa, Homo sapiens
  Payload ID: 9426
  Gene Symbol: LAIR1
  Gene Name: leukocyte-associated immunoglobulin-like receptor 1
  Uniprot ID: Q6GTX8
  ENSP ID: ENSP00000375622
MSPHPTALLGLVLCLAQTIHTQEEDLPRPSISAEPGTVIPLGSHVTFVCRGPVGVQTFRLERDSRSTYNDTEDVSQASPSESEARFRIDSVREGNAGLYRCIYYKPPKWSEQSDYLELLVKESSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46498 - protein, 269 aa, Homo sapiens
  Payload ID: 9426
  Gene Symbol: LAIR1
  Gene Name: leukocyte-associated immunoglobulin-like receptor 1
  ENSP ID: ENSP00000375623
MEREMEDLPRPSISAEPGTVIPLGSHVTFVCRGPVGVQTFRLERDSRSTYNDTEDVSQASPSESEARFRIDSVREGNAGLYRCIYYKPPKWSEQSDYLELLVKESSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46499 - protein, 286 aa, Homo sapiens
  Payload ID: 9426
  Gene Symbol: LAIR1
  Gene Name: leukocyte-associated immunoglobulin-like receptor 1
  ENSP ID: ENSP00000391003
MSPHPTALLGLVLCLAQTIHTQEDLPRPSISAEPGTVIPLGSHVTFVCRGPVGVQTFRLERDSRSTYNDTEDVSQASPSESEARFRIDSVREGNAGLYRCIYYKPPKWSEQSDYLELLVKESSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46500 - protein, 93 aa, Homo sapiens
  Payload ID: 9426
  Gene Symbol: LAIR1
  Gene Name: leukocyte-associated immunoglobulin-like receptor 1
  ENSP ID: ENSP00000392058
MEREMVLCLAQTIHTQEEDLPRPSISAEPGTVIPLGSHVTFVCRGPVGVQTFRLERDSRSTYNDTEDVSQASPSESEARFRIDSVREGNAGLY

SEQ ID NO: 46501 - protein, 44 aa, Homo sapiens
  Payload ID: 9426
  Gene Symbol: LAIR1
  Gene Name: leukocyte-associated immunoglobulin-like receptor 1
  ENSP ID: ENSP00000399710
MSPHPTALLGLVLCLAQTIHTQEVDAEILLCFPPRRSAQTLHLG

SEQ ID NO: 46502 - protein, 44 aa, Homo sapiens; identical to SEQ ID NO: 46501
  Payload ID: 9426
  Gene Symbol: LAIR1
  Gene Name: leukocyte-associated immunoglobulin-like receptor 1
  ENSP ID: ENSP00000411632

SEQ ID NO: 46503 - protein, 153 aa, Homo sapiens
  Payload ID: 9426
  Gene Symbol: LAIR1
  Gene Name: leukocyte-associated immunoglobulin-like receptor 1
  ENSP ID: ENSP00000412796
MSPHPTALLGLVLCLAQTIHTQEEDLPRPSISAEPGTVIPLGSHVTFVCRGPVGVQTFRLERDSRSTYNDTEDVSQASPSESEARFRIDSVREGNAGLYRCIYYKPPKWSEQSDYLELLVKESSGGPDSPDTEPGSSAGPTQRPSDNSHNERE

SEQ ID NO: 46504 - protein, 269 aa, Homo sapiens
  Payload ID: 9426
  Gene Symbol: LAIR1
  Gene Name: leukocyte-associated immunoglobulin-like receptor 1
  Uniprot ID: Q6GTX8
  ENSP ID: ENSP00000418998
MSPHPTALLGLVLCLAQTIHTQEDLPRPSISAEPGTVIPLGSHVTFVCRGPVGVQTFRLERDSRSTYNDTEDVSQASPSESEARFRIDSVREGNAGLYRCIYYKPPKWSEQSDYLELLVKGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46505 - protein, 287 aa, Homo sapiens
  Payload ID: 9426
  Gene Symbol: LAIR1
  Gene Name: leukocyte-associated immunoglobulin-like receptor 1
  ENSP ID: ENSP00000478029
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGRDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46506 - protein, 44 aa, Homo sapiens; identical to SEQ ID NO: 46501
  Payload ID: 9426
  Gene Symbol: LAIR1
  Gene Name: leukocyte-associated immunoglobulin-like receptor 1
  ENSP ID: ENSP00000478330

SEQ ID NO: 46507 - protein, 269 aa, Homo sapiens
  Payload ID: 9426
  Gene Symbol: LAIR1
  Gene Name: leukocyte-associated immunoglobulin-like receptor 1
  Uniprot ID: Q6GTX8
  ENSP ID: ENSP00000478405
MSPHPTALLGLVLCLAQTIHTQEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46508 - protein, 136 aa, Homo sapiens
  Payload ID: 9426
  Gene Symbol: LAIR1
  Gene Name: leukocyte-associated immunoglobulin-like receptor 1
  ENSP ID: ENSP00000478770
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKGPTQRPSDNSHNERE

SEQ ID NO: 46509 - protein, 269 aa, Homo sapiens; identical to SEQ ID NO: 46507
  Payload ID: 9426
  Gene Symbol: LAIR1
  Gene Name: leukocyte-associated immunoglobulin-like receptor 1
  Uniprot ID: Q6GTX8
  ENSP ID: ENSP00000478853

SEQ ID NO: 46510 - protein, 110 aa, Homo sapiens
  Payload ID: 9426
  Gene Symbol: LAIR1
  Gene Name: leukocyte-associated immunoglobulin-like receptor 1
  ENSP ID: ENSP00000478951
MSPHPTALLGLVLCLAQTIHTQEEDLPRPSISAEPGTVIPLGSHVTFVCRGPVGVQTFRLERESRSTYNDTEDVSQASPSESEARFRIDSDPRRGRRTTVTMSMHLLPKA

SEQ ID NO: 46511 - protein, 269 aa, Homo sapiens; identical to SEQ ID NO: 46507
  Payload ID: 9426
  Gene Symbol: LAIR1
  Gene Name: leukocyte-associated immunoglobulin-like receptor 1
  Uniprot ID: Q6GTX8
  ENSP ID: ENSP00000479006

SEQ ID NO: 46512 - protein, 287 aa, Homo sapiens
  Payload ID: 9426
  Gene Symbol: LAIR1
  Gene Name: leukocyte-associated immunoglobulin-like receptor 1
  Uniprot ID: Q6GTX8
  ENSP ID: ENSP00000479133
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46513 - protein, 269 aa, Homo sapiens
  Payload ID: 9426
  Gene Symbol: LAIR1
  Gene Name: leukocyte-associated immunoglobulin-like receptor 1
  ENSP ID: ENSP00000479294
MEREMEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46514 - protein, 270 aa, Homo sapiens
  Payload ID: 9426
  Gene Symbol: LAIR1
  Gene Name: leukocyte-associated immunoglobulin-like receptor 1
  Uniprot ID: Q6GTX8
  ENSP ID: ENSP00000479649
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46515 - protein, 287 aa, Homo sapiens; identical to SEQ ID NO: 46512
  Payload ID: 9426
  Gene Symbol: LAIR1
  Gene Name: leukocyte-associated immunoglobulin-like receptor 1
  Uniprot ID: Q6GTX8
  ENSP ID: ENSP00000479682

SEQ ID NO: 46516 - protein, 287 aa, Homo sapiens; identical to SEQ ID NO: 46512
  Payload ID: 9426
  Gene Symbol: LAIR1
  Gene Name: leukocyte-associated immunoglobulin-like receptor 1
  Uniprot ID: Q6GTX8
  ENSP ID: ENSP00000479707

SEQ ID NO: 46517 - protein, 269 aa, Homo sapiens; identical to SEQ ID NO: 46513
  Payload ID: 9426
  Gene Symbol: LAIR1
  Gene Name: leukocyte-associated immunoglobulin-like receptor 1
  ENSP ID: ENSP00000479951

SEQ ID NO: 46518 - protein, 270 aa, Homo sapiens; identical to SEQ ID NO: 46514
  Payload ID: 9426
  Gene Symbol: LAIR1
  Gene Name: leukocyte-associated immunoglobulin-like receptor 1
  Uniprot ID: Q6GTX8
  ENSP ID: ENSP00000480619

SEQ ID NO: 46519 - protein, 270 aa, Homo sapiens; identical to SEQ ID NO: 46514
  Payload ID: 9426
  Gene Symbol: LAIR1
  Gene Name: leukocyte-associated immunoglobulin-like receptor 1
  Uniprot ID: Q6GTX8
  ENSP ID: ENSP00000480659

SEQ ID NO: 46520 - protein, 269 aa, Homo sapiens; identical to SEQ ID NO: 46507
  Payload ID: 9426
  Gene Symbol: LAIR1
  Gene Name: leukocyte-associated immunoglobulin-like receptor 1
  Uniprot ID: Q6GTX8
  ENSP ID: ENSP00000481204

SEQ ID NO: 46521 - protein, 269 aa, Homo sapiens
  Payload ID: 9426
  Gene Symbol: LAIR1
  Gene Name: leukocyte-associated immunoglobulin-like receptor 1
  ENSP ID: ENSP00000481597
MEREMEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGRDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46522 - protein, 276 aa, Homo sapiens
  Payload ID: 9426
  Gene Symbol: LAIR1
  Gene Name: leukocyte-associated immunoglobulin-like receptor 1
  ENSP ID: ENSP00000482135
MVLCLAQTIHTQEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46523 - protein, 79 aa, Homo sapiens
  Payload ID: 9426
  Gene Symbol: LAIR1
  Gene Name: leukocyte-associated immunoglobulin-like receptor 1
  ENSP ID: ENSP00000482572
EQSDYLELLVKETSGGPDSPDTEPGSSAGTVPGTEASGFDAPRMRRNGLPSCELQWGEIVRMSNRNALIPIHAYTDKNI

SEQ ID NO: 46524 - protein, 286 aa, Homo sapiens
  Payload ID: 9426
  Gene Symbol: LAIR1
  Gene Name: leukocyte-associated immunoglobulin-like receptor 1
  ENSP ID: ENSP00000482633
MSPHPTALLGLVLCLAQTIHTQEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46525 - protein, 270 aa, Homo sapiens; identical to SEQ ID NO: 46514
  Payload ID: 9426
  Gene Symbol: LAIR1
  Gene Name: leukocyte-associated immunoglobulin-like receptor 1
  Uniprot ID: Q6GTX8
  ENSP ID: ENSP00000482922

SEQ ID NO: 46526 - protein, 44 aa, Homo sapiens; identical to SEQ ID NO: 46501
  Payload ID: 9426
  Gene Symbol: LAIR1
  Gene Name: leukocyte-associated immunoglobulin-like receptor 1
  ENSP ID: ENSP00000483342

SEQ ID NO: 46527 - protein, 269 aa, Homo sapiens; identical to SEQ ID NO: 46513
  Payload ID: 9426
  Gene Symbol: LAIR1
  Gene Name: leukocyte-associated immunoglobulin-like receptor 1
  ENSP ID: ENSP00000483622

SEQ ID NO: 46528 - protein, 79 aa, Homo sapiens
  Payload ID: 9426
  Gene Symbol: LAIR1
  Gene Name: leukocyte-associated immunoglobulin-like receptor 1
  ENSP ID: ENSP00000483867
EQSDYLELLVKESSGGPDSPDTEPGSSAGTVPGTEASGFDAPRMRRNGLPSCELQWGEIVRMSNRNALIPIHAYTDKNI

SEQ ID NO: 46529 - protein, 286 aa, Homo sapiens; identical to SEQ ID NO: 46524
  Payload ID: 9426
  Gene Symbol: LAIR1
  Gene Name: leukocyte-associated immunoglobulin-like receptor 1
  ENSP ID: ENSP00000484578

SEQ ID NO: 46530 - protein, 286 aa, Homo sapiens
  Payload ID: 9426
  Gene Symbol: LAIR1
  Gene Name: leukocyte-associated immunoglobulin-like receptor 1
  ENSP ID: ENSP00000484953
MSPHPTALLGLVLCLAQTIHTQEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGRDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 46531 - protein, 152 aa, Homo sapiens
  Payload ID: 9427
  Gene Symbol: LAIR2
  Gene Name: leukocyte-associated immunoglobulin-like receptor 2
  Uniprot ID: Q6ISS4
  ENSP ID: ENSP00000301202
MSPHLTALLGLVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVKESSGGPDSPDTEPGSSAGTVPGTEASGFDAP

SEQ ID NO: 46532 - protein, 135 aa, Homo sapiens
  Payload ID: 9427
  Gene Symbol: LAIR2
  Gene Name: leukocyte-associated immunoglobulin-like receptor 2
  Uniprot ID: Q6ISS4
  ENSP ID: ENSP00000301203
MSPHLTALLGLVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVKGTVPGTEASGFDAP

SEQ ID NO: 46533 - protein, 89 aa, Homo sapiens
  Payload ID: 9427
  Gene Symbol: LAIR2
  Gene Name: leukocyte-associated immunoglobulin-like receptor 2
  ENSP ID: ENSP00000390729
MEREMVLCLAQTIHTQEGALPRPSISAEPGTVISPGSHVTFMCRGPVGVQTFRLEREDRAKYKDSYNVFRLGPSESEARFHIDSVSEGN

SEQ ID NO: 46534 - protein, 152 aa, Homo sapiens; identical to SEQ ID NO: 46531
  Payload ID: 9427
  Gene Symbol: LAIR2
  Gene Name: leukocyte-associated immunoglobulin-like receptor 2
  Uniprot ID: Q6ISS4
  ENSP ID: ENSP00000477535

SEQ ID NO: 46535 - protein, 100 aa, Homo sapiens
  Payload ID: 9427
  Gene Symbol: LAIR2
  Gene Name: leukocyte-associated immunoglobulin-like receptor 2
  ENSP ID: ENSP00000477714
MEREMVLCLAQTIHTQEGALPRPSISAEPGTVISPGSHVTFMCRGPVGVQTFRLEREDRAKYKDSYNVFRLGPSESEARFHIDSVSEGNAGLYRCLYYKP

SEQ ID NO: 46536 - protein, 135 aa, Homo sapiens; identical to SEQ ID NO: 46532
  Payload ID: 9427
  Gene Symbol: LAIR2
  Gene Name: leukocyte-associated immunoglobulin-like receptor 2
  Uniprot ID: Q6ISS4
  ENSP ID: ENSP00000477747

SEQ ID NO: 46537 - protein, 152 aa, Homo sapiens; identical to SEQ ID NO: 46531
  Payload ID: 9427
  Gene Symbol: LAIR2
  Gene Name: leukocyte-associated immunoglobulin-like receptor 2
  Uniprot ID: Q6ISS4
  ENSP ID: ENSP00000478193

SEQ ID NO: 46538 - protein, 175 aa, Homo sapiens
  Payload ID: 9427
  Gene Symbol: LAIR2
  Gene Name: leukocyte-associated immunoglobulin-like receptor 2
  ENSP ID: ENSP00000478866
MSPHLTALLGLVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVKGTVPGTEASGFDAPRMRRNGLPSCELQWGEIIRMSNRNAQMPIHTYTNKKIRFA

SEQ ID NO: 46539 - protein, 77 aa, Homo sapiens
  Payload ID: 9427
  Gene Symbol: LAIR2
  Gene Name: leukocyte-associated immunoglobulin-like receptor 2
  ENSP ID: ENSP00000479882
MEREMGALPRPSISAEPGTVISPGSHVTFMCRGPVGVQTFRLEREDRAKYKDSYNVFRLGPSESEARFHIDSVSEGN

SEQ ID NO: 46540 - protein, 115 aa, Homo sapiens
  Payload ID: 9427
  Gene Symbol: LAIR2
  Gene Name: leukocyte-associated immunoglobulin-like receptor 2
  ENSP ID: ENSP00000480374
MEREMVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVK

SEQ ID NO: 46541 - protein, 77 aa, Homo sapiens; identical to SEQ ID NO: 46539
  Payload ID: 9427
  Gene Symbol: LAIR2
  Gene Name: leukocyte-associated immunoglobulin-like receptor 2
  ENSP ID: ENSP00000480394

SEQ ID NO: 46542 - protein, 77 aa, Homo sapiens; identical to SEQ ID NO: 46539
  Payload ID: 9427
  Gene Symbol: LAIR2
  Gene Name: leukocyte-associated immunoglobulin-like receptor 2
  ENSP ID: ENSP00000480413

SEQ ID NO: 46543 - protein, 89 aa, Homo sapiens; identical to SEQ ID NO: 46533
  Payload ID: 9427
  Gene Symbol: LAIR2
  Gene Name: leukocyte-associated immunoglobulin-like receptor 2
  ENSP ID: ENSP00000480617

SEQ ID NO: 46544 - protein, 135 aa, Homo sapiens; identical to SEQ ID NO: 46532
  Payload ID: 9427
  Gene Symbol: LAIR2
  Gene Name: leukocyte-associated immunoglobulin-like receptor 2
  Uniprot ID: Q6ISS4
  ENSP ID: ENSP00000480904

SEQ ID NO: 46545 - protein, 208 aa, Homo sapiens
  Payload ID: 9427
  Gene Symbol: LAIR2
  Gene Name: leukocyte-associated immunoglobulin-like receptor 2
  ENSP ID: ENSP00000483654
MSPHLTALLGLVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVKESSGGPDSPDTEPGSSAGTVPGTEASGFDAPRMRRNGLPSCELQWGEIIRMSNRNAQMPIHTYTNKKIRFAMENFRPIISIILNMFT

SEQ ID NO: 46546 - protein, 77 aa, Homo sapiens; identical to SEQ ID NO: 46539
  Payload ID: 9427
  Gene Symbol: LAIR2
  Gene Name: leukocyte-associated immunoglobulin-like receptor 2
  ENSP ID: ENSP00000484484

SEQ ID NO: 46547 - protein, 611 aa, Homo sapiens
  Payload ID: 9428
  Gene Symbol: LTA4H
  Gene Name: leukotriene A4 hydrolase
  Uniprot ID: P09960
  ENSP ID: ENSP00000228740
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 46548 - protein, 508 aa, Homo sapiens
  Payload ID: 9428
  Gene Symbol: LTA4H
  Gene Name: leukotriene A4 hydrolase
  Uniprot ID: P09960
  ENSP ID: ENSP00000395051
MLPQRNLSKRQVPTMHIPVKTRRLLAALKVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRMAAALHSIQVGGRNSFGAKDGN

SEQ ID NO: 46549 - protein, 132 aa, Homo sapiens
  Payload ID: 9428
  Gene Symbol: LTA4H
  Gene Name: leukotriene A4 hydrolase
  ENSP ID: ENSP00000449340
MPEIVDTCSLASPASVCRTKHLHLRCSVDFTRRTLTGTAALTVQSQEDNLRSLVLDTKDLTIEKVVINGQEVKYALGERQSYKGSPMEISLPIALSNGSLLNRLLGRNTHISLVSARPSTAEQSFLVRTLLL

SEQ ID NO: 46550 - protein, 587 aa, Homo sapiens
  Payload ID: 9428
  Gene Symbol: LTA4H
  Gene Name: leukotriene A4 hydrolase
  Uniprot ID: P09960
  ENSP ID: ENSP00000449958
MLPQRNLSKRQVPTMHIPVKTRRLLAALKVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 46551 - protein, 352 aa, Homo sapiens
  Payload ID: 9429
  Gene Symbol: LTB4R
  Gene Name: leukotriene B4 receptor
  Uniprot ID: Q15722
  ENSP ID: ENSP00000307445
MNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAALEPGPSESLTASSPLKLNELN

SEQ ID NO: 46552 - protein, 352 aa, Homo sapiens; identical to SEQ ID NO: 46551
  Payload ID: 9429
  Gene Symbol: LTB4R
  Gene Name: leukotriene B4 receptor
  Uniprot ID: Q15722
  ENSP ID: ENSP00000380002

SEQ ID NO: 46553 - protein, 352 aa, Homo sapiens; identical to SEQ ID NO: 46551
  Payload ID: 9429
  Gene Symbol: LTB4R
  Gene Name: leukotriene B4 receptor
  Uniprot ID: Q15722
  ENSP ID: ENSP00000380008

SEQ ID NO: 46554 - protein, 102 aa, Homo sapiens
  Payload ID: 9429
  Gene Symbol: LTB4R
  Gene Name: leukotriene B4 receptor
  ENSP ID: ENSP00000450457
MNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMY

SEQ ID NO: 46555 - protein, 232 aa, Homo sapiens
  Payload ID: 9429
  Gene Symbol: LTB4R
  Gene Name: leukotriene B4 receptor
  ENSP ID: ENSP00000451929
MYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAAL

SEQ ID NO: 46556 - protein, 389 aa, Homo sapiens
  Payload ID: 9430
  Gene Symbol: LTB4R2
  Gene Name: leukotriene B4 receptor 2
  Uniprot ID: Q9NPC1
  ENSP ID: ENSP00000432146
MAPSHRASQVGFCPTPERPLWRLPPTCRPRRMSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGRSREGTMELRTTPQLKVVGQGRGNGDPGGGMEKDGPEWDL

SEQ ID NO: 46557 - protein, 358 aa, Homo sapiens
  Payload ID: 9430
  Gene Symbol: LTB4R2
  Gene Name: leukotriene B4 receptor 2
  Uniprot ID: Q9NPC1
  ENSP ID: ENSP00000433290
MSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGRSREGTMELRTTPQLKVVGQGRGNGDPGGGMEKDGPEWDL

SEQ ID NO: 46558 - protein, 319 aa, Homo sapiens
  Payload ID: 9430
  Gene Symbol: LTB4R2
  Gene Name: leukotriene B4 receptor 2
  ENSP ID: ENSP00000434760
MSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGR

SEQ ID NO: 46559 - protein, 160 aa, Homo sapiens
  Payload ID: 9430
  Gene Symbol: LTB4R2
  Gene Name: leukotriene B4 receptor 2
  ENSP ID: ENSP00000436668
MSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYR

SEQ ID NO: 46560 - protein, 358 aa, Homo sapiens; identical to SEQ ID NO: 46557
  Payload ID: 9430
  Gene Symbol: LTB4R2
  Gene Name: leukotriene B4 receptor 2
  Uniprot ID: Q9NPC1
  ENSP ID: ENSP00000445772

SEQ ID NO: 46561 - protein, 150 aa, Homo sapiens
  Payload ID: 9431
  Gene Symbol: LTC4S
  Gene Name: leukotriene C4 synthase
  Uniprot ID: Q16873
  ENSP ID: ENSP00000292596
MKDEVALLAAVTLLGVLLQAYFSLQVISARRAFRVSPPLTTGPPEFERVYRAQVNCSEYFPLFLATLWVAGIFFHEGAAALCGLVYLFARLRYFQGYARSAQLRLAPLYASARALWLLVALAALGLLAHFLPAALRAALLGRLRTLLPWA

SEQ ID NO: 46562 - protein, 93 aa, Homo sapiens
  Payload ID: 9431
  Gene Symbol: LTC4S
  Gene Name: leukotriene C4 synthase
  ENSP ID: ENSP00000385627
MKDEVALLAAVTLLGVLLQGAAALCGLVYLFARLRYFQGYARSAQLRLAPLYASARALWLLVALAALGLLAHFLPAALRAALLGRLRTLLPWA

SEQ ID NO: 46563 - protein, 69 aa, Homo sapiens
  Payload ID: 9431
  Gene Symbol: LTC4S
  Gene Name: leukotriene C4 synthase
  ENSP ID: ENSP00000427299
MKDEVALLAAVTLLGVLLQGDLGAQGLPRVAAAHHRPTRVRARLPSPGELQRVLPAVPRHALGRRHLLS

SEQ ID NO: 46564 - protein, 386 aa, Homo sapiens
  Payload ID: 9432
  Gene Symbol: LPXN
  Gene Name: leupaxin
  Uniprot ID: O60711
  ENSP ID: ENSP00000378512
MEELDALLEELERSTLQDSDEYSNPAPLPLDQHSRKETNLDETSEILSIQDNTSPLPAQLVYTTNIQELNVYSEAQEPKESPPPSKTSAAAQLDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLAYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 46565 - protein, 391 aa, Homo sapiens
  Payload ID: 9432
  Gene Symbol: LPXN
  Gene Name: leupaxin
  Uniprot ID: O60711
  ENSP ID: ENSP00000431284
MSTLLISSSDALLEELERSTLQDSDEYSNPAPLPLDQHSRKETNLDETSEILSIQDNTSPLPAQLVYTTNIQELNVYSEAQEPKESPPPSKTSAAAQLDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLAYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 46566 - protein, 106 aa, Homo sapiens
  Payload ID: 9432
  Gene Symbol: LPXN
  Gene Name: leupaxin
  ENSP ID: ENSP00000437094
MEELDALLEELERSTLQDSDEYSNPAPLPLDQHSRKETNLDETSEILSIQDNTSPLPAQLVYTTNIQELNVYSEAQEPKESPPPSKTSAAAQLDELMAHLTEMQAK

SEQ ID NO: 46567 - protein, 366 aa, Homo sapiens
  Payload ID: 9432
  Gene Symbol: LPXN
  Gene Name: leupaxin
  ENSP ID: ENSP00000461855
MPYWRNWNAPPFRTVMNIPTQLLFPWISIPERRLTLMRLRRSFLFRITQVPCREAQEPKESPPPSKTSAAAQLDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLAYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 46568 - protein, 379 aa, Homo sapiens
  Payload ID: 9433
  Gene Symbol: LFNG
  Gene Name: LFNG O-fucosylpeptide 3-beta-N-acetylglucosaminyltransferase
  Uniprot ID: Q8NES3
  ENSP ID: ENSP00000222725
MLKRCGRRLLLALAGALLACLLVLTADPPPPPLPAERGRRALRSLAGPAGAAPAPGLGAAAAAPGALVRDVHSLSEYFSLLTRARRDAGPPPGAAPRPADGHPRPLAEPLAPRDVFIAVKTTKKFHRARLDLLLETWISRHKEMTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 46569 - protein, 250 aa, Homo sapiens
  Payload ID: 9433
  Gene Symbol: LFNG
  Gene Name: LFNG O-fucosylpeptide 3-beta-N-acetylglucosaminyltransferase
  Uniprot ID: Q8NES3
  ENSP ID: ENSP00000343095
MTPGRCCLAADIQVETFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 46570 - protein, 361 aa, Homo sapiens
  Payload ID: 9433
  Gene Symbol: LFNG
  Gene Name: LFNG O-fucosylpeptide 3-beta-N-acetylglucosaminyltransferase
  Uniprot ID: Q8NES3
  ENSP ID: ENSP00000352579
MLKRCGRRLLLALAGALLACLLVLTADPPPPPLPAERGRRALRSLAGPAGAAPAPGLGAAAAAPGALVRDVHSLSEYFSLLTRARRDAGPPPGAAPRPADGHPRPLAEPLAPRDVFIAVKTTKKFHRARLDLLLETWISRHKEMTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRWGN

SEQ ID NO: 46571 - protein, 250 aa, Homo sapiens; identical to SEQ ID NO: 46569
  Payload ID: 9433
  Gene Symbol: LFNG
  Gene Name: LFNG O-fucosylpeptide 3-beta-N-acetylglucosaminyltransferase
  Uniprot ID: Q8NES3
  ENSP ID: ENSP00000384786

SEQ ID NO: 46572 - protein, 308 aa, Homo sapiens
  Payload ID: 9433
  Gene Symbol: LFNG
  Gene Name: LFNG O-fucosylpeptide 3-beta-N-acetylglucosaminyltransferase
  Uniprot ID: Q8NES3
  ENSP ID: ENSP00000385764
MDEQTGRLRLDTYCMSAKQIWAWSKCSGRLWDEHMKWMEGWTDRWTDGWMDGWMDEWSPTPALRSYGGGLSQQTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 46573 - protein, 248 aa, Homo sapiens
  Payload ID: 9433
  Gene Symbol: LFNG
  Gene Name: LFNG O-fucosylpeptide 3-beta-N-acetylglucosaminyltransferase
  ENSP ID: ENSP00000483986
MKGCLLKADFLLQTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 46574 - protein, 433 aa, Homo sapiens
  Payload ID: 9434
  Gene Symbol: LCOR
  Gene Name: ligand dependent nuclear receptor corepressor
  Uniprot ID: Q96JN0
  ENSP ID: ENSP00000348298
MQRMIQQFAAEYTSKNSSTQDPSQPNSTKNQSLPKASPVTTSPTAATTQNPVLSKLLMADQDSPLDLTVRKSQSEPSEQDGVLDLSTKKSPCAGSTSLSHSPGCSSTQGNGRPGRPSQYRPDGLRSGDGVPPRSLQDGTREGFGHSTSLKVPLARSLQISEELLSRNQLSTAASLGPSGLQNHGQHLILSREASWAKPHYEFNLSRMKFRGNGALSNISDLPFLAENSAFPKMALQAKQDGKKDVSHSSPVDLKIPQVRGMDLSWESRTGDQYSYSSLVMGSQTESALSKKLRAILPKQSRKSMLDAGPDSWGSDAEQSTSGQPYPTSDQEGDPGSKQPRKKRGRYRQYNSEILEEAISVVMSGKMSVSKAQSIYGIPHSTLEYKVKERLGTLKNPPKKKMKLMRSEGPDVSVKIELDPQGEAAQSANESKNE

SEQ ID NO: 46575 - protein, 433 aa, Homo sapiens; identical to SEQ ID NO: 46574
  Payload ID: 9434
  Gene Symbol: LCOR
  Gene Name: ligand dependent nuclear receptor corepressor
  Uniprot ID: Q96JN0
  ENSP ID: ENSP00000360138

SEQ ID NO: 46576 - protein, 433 aa, Homo sapiens; identical to SEQ ID NO: 46574
  Payload ID: 9434
  Gene Symbol: LCOR
  Gene Name: ligand dependent nuclear receptor corepressor
  Uniprot ID: Q96JN0
  ENSP ID: ENSP00000360144

SEQ ID NO: 46577 - protein, 406 aa, Homo sapiens
  Payload ID: 9434
  Gene Symbol: LCOR
  Gene Name: ligand dependent nuclear receptor corepressor
  Uniprot ID: Q96JN0
  ENSP ID: ENSP00000443431
MQRMIQQFAAEYTSKNSSTQDPSQPNSTKNQSLPKASPVTTSPTAATTQNPVLSKLLMADQDSPLDLTVRKSQSEPSEQDGVLDLSTKKSPCAGSTSLSHSPGCSSTQGNGRPGRPSQYRPDGLRSGDGVPPRSLQDGTREGFGHSTSLKVPLARSLQISEELLSRNQLSTAASLGPSGLQNHGQHLILSREASWAKPHYEFNLSRMKFRGNGALSNISDLPFLAENSAFPKMALQAKQDGKKDVSHSSPVDLKIPQVRGMDLSWESRTGDQYSYSSLVMGSQTESALSKKLRAILPKQSRKSMLDAGPDSWGSDAEQSTSGQPYPTSDQEGDPGSKQPRKKRGRYRQYNSEILEEAISVVMSGKMSVSKAQSIYGIPHSTLEYKVKERLGTLKNPPKKKMKLMSG

SEQ ID NO: 46578 - protein, 318 aa, Homo sapiens
  Payload ID: 9435
  Gene Symbol: LCORL
  Gene Name: ligand dependent nuclear receptor corepressor-like
  Uniprot ID: Q8N3X6
  ENSP ID: ENSP00000317566
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGMLQVKTDEKLNVSDENTASCPLSPIKMCLNRPIEWNLNLTTASLTSCTVHNQNLKSEEK

SEQ ID NO: 46579 - protein, 518 aa, Homo sapiens
  Payload ID: 9435
  Gene Symbol: LCORL
  Gene Name: ligand dependent nuclear receptor corepressor-like
  ENSP ID: ENSP00000371659
MDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGRLHRNREDYVERSAEFADGLLSKALKDIQSGALDINKAGILYGIPQKTLLLHLEALPAGKPASFKNKTRDFHDSYSYKDSKETCAVLQKVALWARAQAERTEKSKLNLLETSEIKFPTASTYLHQLTLQKMVTQFKEKNESLQYETSNPTVQLKIPQLRVSSVSKSQPDGSGLLDVMYQVSKTSSVLEGSALQKLKNILPKQNKIECSGPVTHSSVDSYFLHGDLSPLCLNSKNGTVDGTSENTEDGLDRKDSKQPRKKRGRYRQYDHEIMEEAIAMVMSGKMSVSKAQGIYGVPHSTLEYKVKERSGTLKTPPKKKLRLPDTGLYNMTDSGTGSCKNSSKPV

SEQ ID NO: 46580 - protein, 602 aa, Homo sapiens
  Payload ID: 9435
  Gene Symbol: LCORL
  Gene Name: ligand dependent nuclear receptor corepressor-like
  Uniprot ID: Q8N3X6
  ENSP ID: ENSP00000371661
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGRLHRNREDYVERSAEFADGLLSKALKDIQSGALDINKAGILYGIPQKTLLLHLEALPAGKPASFKNKTRDFHDSYSYKDSKETCAVLQKVALWARAQAERTEKSKLNLLETSEIKFPTASTYLHQLTLQKMVTQFKEKNESLQYETSNPTVQLKIPQLRVSSVSKSQPDGSGLLDVMYQVSKTSSVLEGSALQKLKNILPKQNKIECSGPVTHSSVDSYFLHGDLSPLCLNSKNGTVDGTSENTEDGLDRKDSKQPRKKRGRYRQYDHEIMEEAIAMVMSGKMSVSKAQGIYGVPHSTLEYKVKERSGTLKTPPKKKLRLPDTGLYNMTDSGTGSCKNSSKPV

SEQ ID NO: 46581 - protein, 79 aa, Homo sapiens
  Payload ID: 9435
  Gene Symbol: LCORL
  Gene Name: ligand dependent nuclear receptor corepressor-like
  ENSP ID: ENSP00000423489
MDKGRERMAAAAAAAAAAAAAAQCRSPRCAAERRGFRRELDSWRHRLMHCVGFESILEGLYGPRLRRDLSLFEGLYTIS

SEQ ID NO: 46582 - protein, 769 aa, Homo sapiens
  Payload ID: 9436
  Gene Symbol: LRIF1
  Gene Name: ligand dependent nuclear receptor interacting factor 1
  Uniprot ID: Q5T3J3
  ENSP ID: ENSP00000358778
MSNNLRRVFLKPAEENSGNASRCVSGCMYQVVQTIGSDGKNLLQLLPIPKSSGNLIPLVQSSVMSDALKGNTGKPVQVTFQTQISSSSTSASVQLPIFQPASSSNYFLTRTVDTSEKGRVTSVGTGNFSSSVSKVQSHGVKIDGLTMQTFAVPPSTQKDSSFIVVNTQSLPVTVKSPVLPSGHHLQIPAHAEVKSVPASSLPPSVQQKILATATTSTSGMVEASQMPTVIYVSPVNTVKNVVTKNFQNIYPKPVTEIAKPVILNTTQIPKNVATETQLKGGQHSQAAPVKWIFQDNLQPFTPSLVPVKSSNNVASKILKTFVDRKNLGDNTINMPPLSTIDPSGTRSKNMPIKDNALVMFNGKVYLLAKKGTDVLPSQIDQQNSVSPDTPVRKDTLQTVSSSPVTEISREVVNIVLAKSKSSQMETKSLSNTQLASMANLRAEKNKVEKPSPSTTNPHMNQSSNYLKQSKTLFTNPIFPVGFSTGHNAPRKVTAVIYARKGSVLQSIEKISSSVDATTVTSQQCVFRDQEPKIHNEMASTSDKGAQGRNDKKDSQGRSNKALHLKSDAEFKKIFGLTKDLRVCLTRIPDHLTSGEGFDSFSSLVKSGTYKETEFMVKEGERKQQNFDKKRKAKTNKKMDHIKKRKTENAYNAIINGEANVTGSQLLSSILPTSDVSQHNILTSHSKTRQEKRTEMEYYTHEKQEKGTLNSNAAYEQSHFFNKNYTEDIFPVTPPELEETIRDEKIRRLKQVLREKEAALEEMRKKMHQK

SEQ ID NO: 46583 - protein, 233 aa, Homo sapiens
  Payload ID: 9436
  Gene Symbol: LRIF1
  Gene Name: ligand dependent nuclear receptor interacting factor 1
  Uniprot ID: Q5T3J3
  ENSP ID: ENSP00000432290
MASTSDKGAQGRNDKKDSQGRSNKALHLKSDAEFKKIFGLTKDLRVCLTRIPDHLTSGEGFDSFSSLVKSGTYKETEFMVKEGERKQQNFDKKRKAKTNKKMDHIKKRKTENAYNAIINGEANVTGSQLLSSILPTSDVSQHNILTSHSKTRQEKRTEMEYYTHEKQEKGTLNSNAAYEQSHFFNKNYTEDIFPVTPPELEETIRDEKIRRLKQVLREKEAALEEMRKKMHQK

SEQ ID NO: 46584 - protein, 233 aa, Homo sapiens; identical to SEQ ID NO: 46583
  Payload ID: 9436
  Gene Symbol: LRIF1
  Gene Name: ligand dependent nuclear receptor interacting factor 1
  Uniprot ID: Q5T3J3
  ENSP ID: ENSP00000435259

SEQ ID NO: 46585 - protein, 728 aa, Homo sapiens
  Payload ID: 9437
  Gene Symbol: LNX1
  Gene Name: ligand of numb-protein X 1, E3 ubiquitin protein ligase
  Uniprot ID: Q8TBB1
  ENSP ID: ENSP00000263925
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLNKLLVTCPFREHCTQVLQRCDLEHHFQTSCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 46586 - protein, 632 aa, Homo sapiens
  Payload ID: 9437
  Gene Symbol: LNX1
  Gene Name: ligand of numb-protein X 1, E3 ubiquitin protein ligase
  Uniprot ID: Q8TBB1
  ENSP ID: ENSP00000302879
MKALLLLVLPWLSPANYIDNVGNLHFLYSELCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 46587 - protein, 99 aa, Homo sapiens
  Payload ID: 9437
  Gene Symbol: LNX1
  Gene Name: ligand of numb-protein X 1, E3 ubiquitin protein ligase
  ENSP ID: ENSP00000421897
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLN

SEQ ID NO: 46588 - protein, 6 aa, Homo sapiens
  Payload ID: 9437
  Gene Symbol: LNX1
  Gene Name: ligand of numb-protein X 1, E3 ubiquitin protein ligase
  ENSP ID: ENSP00000423344
MNQPES

SEQ ID NO: 46589 - protein, 90 aa, Homo sapiens
  Payload ID: 9437
  Gene Symbol: LNX1
  Gene Name: ligand of numb-protein X 1, E3 ubiquitin protein ligase
  ENSP ID: ENSP00000424364
MNQPESANDPEPLCAVCGQAHSLEENHFYSYPEEVDDDLICHICLQALLDPLDTPCGHTYCTLCLTNFLVEKDFCPMDRKPLVLQHCKKS

SEQ ID NO: 46590 - protein, 16 aa, Homo sapiens
  Payload ID: 9437
  Gene Symbol: LNX1
  Gene Name: ligand of numb-protein X 1, E3 ubiquitin protein ligase
  ENSP ID: ENSP00000425135
MNQPESANDPEPLCAV

SEQ ID NO: 46591 - protein, 125 aa, Homo sapiens
  Payload ID: 9437
  Gene Symbol: LNX1
  Gene Name: ligand of numb-protein X 1, E3 ubiquitin protein ligase
  ENSP ID: ENSP00000426445
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLNKLLVTCPFREHCTQVLQRCDLEHHFQ

SEQ ID NO: 46592 - protein, 690 aa, Homo sapiens [sequence omitted]

SEQ ID NO: 46593 - protein, 919 aa, Homo sapiens
  Payload ID: 9439
  Gene Symbol: LIG1
  Gene Name: ligase I, DNA, ATP-dependent
  Uniprot ID: P18858
  ENSP ID: ENSP00000263274
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 46594 - protein, 851 aa, Homo sapiens
  Payload ID: 9439
  Gene Symbol: LIG1
  Gene Name: ligase I, DNA, ATP-dependent
  ENSP ID: ENSP00000441531
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTEAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 46595 - protein, 888 aa, Homo sapiens
  Payload ID: 9439
  Gene Symbol: LIG1
  Gene Name: ligase I, DNA, ATP-dependent
  Uniprot ID: P18858
  ENSP ID: ENSP00000442841
MQRSIMAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 46596 - protein, 415 aa, Homo sapiens
  Payload ID: 9439
  Gene Symbol: LIG1
  Gene Name: ligase I, DNA, ATP-dependent
  ENSP ID: ENSP00000445928
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRERRETRSHNCHPRHPHPRSPLKVGSWSPSGLRQPRKATWGWWPRTAAAPRGSCCHHLRSLPPGSSASSATSPGSLAVLPQPRR

SEQ ID NO: 46597 - protein, 145 aa, Homo sapiens
  Payload ID: 9439
  Gene Symbol: LIG1
  Gene Name: ligase I, DNA, ATP-dependent
  ENSP ID: ENSP00000469638
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDED

SEQ ID NO: 46598 - protein, 800 aa, Homo sapiens
  Payload ID: 9439
  Gene Symbol: LIG1
  Gene Name: ligase I, DNA, ATP-dependent
  ENSP ID: ENSP00000471380
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKVLGNWG

SEQ ID NO: 46599 - protein, 801 aa, Homo sapiens
  Payload ID: 9439
  Gene Symbol: LIG1
  Gene Name: ligase I, DNA, ATP-dependent
  Uniprot ID: P18858
  ENSP ID: ENSP00000471836
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKVLGNWG

SEQ ID NO: 46600 - protein, 149 aa, Homo sapiens
  Payload ID: 9439
  Gene Symbol: LIG1
  Gene Name: ligase I, DNA, ATP-dependent
  ENSP ID: ENSP00000471861
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTEAETPTESVSEPEVATKQELQEEEEQ

SEQ ID NO: 46601 - protein, 28 aa, Homo sapiens
  Payload ID: 9439
  Gene Symbol: LIG1
  Gene Name: ligase I, DNA, ATP-dependent
  ENSP ID: ENSP00000472085
MQRSIMSFFHPKKEGKAKKPEKEASNSS

SEQ ID NO: 46602 - protein, 36 aa, Homo sapiens
  Payload ID: 9439
  Gene Symbol: LIG1
  Gene Name: ligase I, DNA, ATP-dependent
  ENSP ID: ENSP00000472331
  MOD_RES (1)..(1): Any amino acid
XWLEEQGMILKQTFWDSPETNVGPSHPGHQRGPETL

SEQ ID NO: 46603 - protein, 801 aa, Homo sapiens; identical to SEQ ID NO: 46599
  Payload ID: 9439
  Gene Symbol: LIG1
  Gene Name: ligase I, DNA, ATP-dependent
  Uniprot ID: P18858
  ENSP ID: ENSP00000483027

SEQ ID NO: 46604 - protein, 949 aa, Homo sapiens
  Payload ID: 9440
  Gene Symbol: LIG3
  Gene Name: ligase III, DNA, ATP-dependent
  Uniprot ID: P49916
  ENSP ID: ENSP00000262327
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKRRPASEQRGRTVPAGRR

SEQ ID NO: 46605 - protein, 1009 aa, Homo sapiens
  Payload ID: 9440
  Gene Symbol: LIG3
  Gene Name: ligase III, DNA, ATP-dependent
  Uniprot ID: P49916
  ENSP ID: ENSP00000367787
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPC

SEQ ID NO: 46606 - protein, 36 aa, Homo sapiens
  Payload ID: 9440
  Gene Symbol: LIG3
  Gene Name: ligase III, DNA, ATP-dependent
  ENSP ID: ENSP00000465288
  MOD_RES (1)..(1): Any amino acid
XKFLHDNMVEIPNRIMFSEMKRVTHLSCPSESFGLG

SEQ ID NO: 46607 - protein, 38 aa, Homo sapiens
  Payload ID: 9440
  Gene Symbol: LIG3
  Gene Name: ligase III, DNA, ATP-dependent
  ENSP ID: ENSP00000466278
  MOD_RES (1)..(1): Any amino acid
XARATTKKIEDLTELEGWEELEDNEKEQITQHIAEIVH

SEQ ID NO: 46608 - protein, 207 aa, Homo sapiens
  Payload ID: 9440
  Gene Symbol: LIG3
  Gene Name: ligase III, DNA, ATP-dependent
  ENSP ID: ENSP00000467063
MAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGS

SEQ ID NO: 46609 - protein, 185 aa, Homo sapiens
  Payload ID: 9440
  Gene Symbol: LIG3
  Gene Name: ligase III, DNA, ATP-dependent
  ENSP ID: ENSP00000467757
MVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLH

SEQ ID NO: 46610 - protein, 545 aa, Homo sapiens
  Payload ID: 9440
  Gene Symbol: LIG3
  Gene Name: ligase III, DNA, ATP-dependent
  ENSP ID: ENSP00000468479
MSKFRGLRYMSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPH

SEQ ID NO: 46611 - protein, 911 aa, Homo sapiens
  Payload ID: 9441
  Gene Symbol: LIG4
  Gene Name: ligase IV, DNA, ATP-dependent
  Uniprot ID: P49917
  ENSP ID: ENSP00000349393
MAASQTSQTVASHVPFADLCSTLERIQKSKGRAEKIRHFREFLDSWRKFHDALHKNHKDVTDSFYPAMRLILPQLERERMAYGIKETMLAKLYIELLNLPRDGKDALKLLNYRTPTGTHGDAGDFAMIAYFVLKPRCLQKGSLTIQQVNDLLDSIASNNSAKRKDLIKKSLLQLITQSSALEQKWLIRMIIKDLKLGVSQQTIFSVFHNDAAELHNVTTDLEKVCRQLHDPSVGLSDISITLFSAFKPMLAAIADIEHIEKDMKHQSFYIETKLDGERMQMHKDGDVYKYFSRNGYNYTDQFGASPTEGSLTPFIHNAFKADIQICILDGEMMAYNPNTQTFMQKGTKFDIKRMVEDSDLQTCYCVFDVLMVNNKKLGHETLRKRYEILSSIFTPIPGRIEIVQKTQAHTKNEVIDALNEAIDKREEGIMVKQPLSIYKPDKRGEGWLKIKPEYVSGLMDELDILIVGGYWGKGSRGGMMSHFLCAVAEKPPPGEKPSVFHTLSRVGSGCTMKELYDLGLKLAKYWKPFHRKAPPSSILCGTEKPEVYIEPCNSVIVQIKAAEIVPSDMYKTGCTLRFPRIEKIRDDKEWHECMTLDDLEQLRGKASGKLASKHLYIGGDDEPQEKKRKAAPKMKKVIGIIEHLKAPNLTNVNKISNIFEDVEFCVMSGTDSQPKPDLENRIAEFGGYIVQNPGPDTYCVIAGSENIRVKNIILSNKHDVVKPAWLLECFKTKSFVPWQPRFMIHMCPSTKEHFAREYDCYGDSYFIDTDLNQLKEVFSGIKNSNEQTPEEMASLIADLEYRYSWDCSPLSMFRRHTVYLDSYAVINDLSTKNEGTRLAIKALELRFHGAKVVSCLAEGVSHVIIGEDHSRVADFKAFRRTFKRKFKILKESWVTDSIDKCELQEENQYLI

SEQ ID NO: 46612 - protein, 911 aa, Homo sapiens; identical to SEQ ID NO: 46611
  Payload ID: 9441
  Gene Symbol: LIG4
  Gene Name: ligase IV, DNA, ATP-dependent
  Uniprot ID: P49917
  ENSP ID: ENSP00000385955

SEQ ID NO: 46613 - protein, 911 aa, Homo sapiens; identical to SEQ ID NO: 46611
  Payload ID: 9441
  Gene Symbol: LIG4
  Gene Name: ligase IV, DNA, ATP-dependent
  Uniprot ID: P49917
  ENSP ID: ENSP00000402030

SEQ ID NO: 46614 - protein, 844 aa, Homo sapiens
  Payload ID: 9441
  Gene Symbol: LIG4
  Gene Name: ligase IV, DNA, ATP-dependent
  ENSP ID: ENSP00000480814
MRLILPQLERERMAYGIKETMLAKLYIELLNLPRDGKDALKLLNYRTPTGTHGDAGDFAMIAYFVLKPRCLQKGSLTIQQVNDLLDSIASNNSAKRKDLIKKSLLQLITQSSALEQKWLIRMIIKDLKLGVSQQTIFSVFHNDAAELHNVTTDLEKVCRQLHDPSVGLSDISITLFSAFKPMLAAIADIEHIEKDMKHQSFYIETKLDGERMQMHKDGDVYKYFSRNGYNYTDQFGASPTEGSLTPFIHNAFKADIQICILDGEMMAYNPNTQTFMQKGTKFDIKRMVEDSDLQTCYCVFDVLMVNNKKLGHETLRKRYEILSSIFTPIPGRIEIVQKTQAHTKNEVIDALNEAIDKREEGIMVKQPLSIYKPDKRGEGWLKIKPEYVSGLMDELDILIVGGYWGKGSRGGMMSHFLCAVAEKPPPGEKPSVFHTLSRVGSGCTMKELYDLGLKLAKYWKPFHRKAPPSSILCGTEKPEVYIEPCNSVIVQIKAAEIVPSDMYKTGCTLRFPRIEKIRDDKEWHECMTLDDLEQLRGKASGKLASKHLYIGGDDEPQEKKRKAAPKMKKVIGIIEHLKAPNLTNVNKISNIFEDVEFCVMSGTDSQPKPDLENRIAEFGGYIVQNPGPDTYCVIAGSENIRVKNIILSNKHDVVKPAWLLECFKTKSFVPWQPRFMIHMCPSTKEHFAREYDCYGDSYFIDTDLNQLKEVFSGIKNSNEQTPEEMASLIADLEYRYSWDCSPLSMFRRHTVYLDSYAVINDLSTKNEGTRLAIKALELRFHGAKVVSCLAEGVSHVIIGEDHSRVADFKAFRRTFKRKFKILKESWVTDSIDKCELQEENQYLI

SEQ ID NO: 46615 - protein, 911 aa, Homo sapiens; identical to SEQ ID NO: 46611
  Payload ID: 9441
  Gene Symbol: LIG4
  Gene Name: ligase IV, DNA, ATP-dependent
  Uniprot ID: P49917
  ENSP ID: ENSP00000484288

SEQ ID NO: 46616 - protein, 756 aa, Homo sapiens
  Payload ID: 9442
  Gene Symbol: LARGE
  Gene Name: like-glycosyltransferase
  Uniprot ID: O95461
  ENSP ID: ENSP00000347088
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKCETIHVAIVCAGYNASRDVVTLVKSVLFHRRNPLHFHLIADSIAEQILATLFQTWMVPAVRVDFYNADELKSEVSWIPNKHYSGIYGLMKLVLTKTLPANLERVIVLDTDITFATDIAELWAVFHKFKGQQVLGLVENQSDWYLGNLWKNHRPWPALGRGYNTGVILLLLDKLRKMKWEQMWRLTAERELMGMLSTSLADQDIFNAVIKQNPFLVYQLPCFWNVQLSDHTRSEQCYRDVSDLKVIHWNSPKKLRVKNKHVEFFRNLYLTFLEYDGNLLRRELFGCPSEADVNSENLQKQLSELDEDDLCYEFRRERFTVHRTHLYFLHYEYEPAADSTDVTLVAQLSMDRLQMLEAICKHWEGPISLALYLSDAEAQQFLRYAQGSEVLMSRHNVGYHIVYKEGQFYPVNLLRNVAMKHISTPYMFLSDIDFLPMYGLYEYLRKSVIQLDLANTKKAMIVPAFETLRYRLSFPKSKAELLSMLDMGTLFTFRYHVWTKGHAPTNFAKWRTATTPYRVEWEADFEPYVVVRRDCPEYDRRFVGFGWNKVAHIMELDVQEYEFIVLPNAYMIHMPHAPSFDITKFRSNKQYRICLKTLKEEFQQDMSRRYGFAALKYLTAENNS

SEQ ID NO: 46617 - protein, 756 aa, Homo sapiens; identical to SEQ ID NO: 46616
  Payload ID: 9442
  Gene Symbol: LARGE
  Gene Name: like-glycosyltransferase
  Uniprot ID: O95461
  ENSP ID: ENSP00000380549

SEQ ID NO: 46618 - protein, 704 aa, Homo sapiens
  Payload ID: 9442
  Gene Symbol: LARGE
  Gene Name: like-glycosyltransferase
  Uniprot ID: O95461
  ENSP ID: ENSP00000385223
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKCETIHVAIVCAGYNASRDVVTLVKSVLFHRRNPLHFHLIADSIAEQILATLFQTWMVPAVRVDFYNADELKSEVSWIPNKHYSGIYGLMKLVLTKTLPANLERVIVLDTDITFATDIAELWAVFHKFKGQQVLGLVENQSDWYLGNLWKNHRPWPALGRGYNTGVILLLLDKLRKMKWEQMWRLTAERELMGMLSTSLADQDIFNAVIKQNPFLVYQLPCFWNVQLSDHTRSEQCYRDVSDLKLQKQLSELDEDDLCYEFRRERFTVHRTHLYFLHYEYEPAADSTDVTLVAQLSMDRLQMLEAICKHWEGPISLALYLSDAEAQQFLRYAQGSEVLMSRHNVGYHIVYKEGQFYPVNLLRNVAMKHISTPYMFLSDIDFLPMYGLYEYLRKSVIQLDLANTKKAMIVPAFETLRYRLSFPKSKAELLSMLDMGTLFTFRYHVWTKGHAPTNFAKWRTATTPYRVEWEADFEPYVVVRRDCPEYDRRFVGFGWNKVAHIMELDVQEYEFIVLPNAYMIHMPHAPSFDITKFRSNKQYRICLKTLKEEFQQDMSRRYGFAALKYLTAENNS

SEQ ID NO: 46619 - protein, 108 aa, Homo sapiens
  Payload ID: 9442
  Gene Symbol: LARGE
  Gene Name: like-glycosyltransferase
  ENSP ID: ENSP00000389605
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGT

SEQ ID NO: 46620 - protein, 136 aa, Homo sapiens
  Payload ID: 9442
  Gene Symbol: LARGE
  Gene Name: like-glycosyltransferase
  ENSP ID: ENSP00000396277
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKCE

SEQ ID NO: 46621 - protein, 187 aa, Homo sapiens
  Payload ID: 9442
  Gene Symbol: LARGE
  Gene Name: like-glycosyltransferase
  ENSP ID: ENSP00000403841
MLIWSEVSWIPNKHYSGIYGLMKLVLTKTLPANLERVIVLDTDITFATDIAELWAVFHKFKGQQVLGLVENQSDWYLGNLWKNHRPWPALGRGYNTGVILLLLDKLRKMKWEQMWRLTAERELMGMLSTSLADQDIFNAVIKQNPFLVYQLPCFWNVQLSDHTRSEQCYRDVSDLKVIHWNSPKKLR

SEQ ID NO: 46622 - protein, 47 aa, Homo sapiens
  Payload ID: 9442
  Gene Symbol: LARGE
  Gene Name: like-glycosyltransferase
  ENSP ID: ENSP00000406000
MLGICRGRRKFLAASLSLLCIPAITWIYLFSGSFEDGKPVSLSPLES

SEQ ID NO: 46623 - protein, 60 aa, Homo sapiens
  Payload ID: 9442
  Gene Symbol: LARGE
  Gene Name: like-glycosyltransferase
  ENSP ID: ENSP00000411065
MLGICRGRRKFLAASLSLLCIPAITWIYLFSGSFEDGKPVSLSPLESQAHSPRYTASSQR

SEQ ID NO: 46624 - protein, 135 aa, Homo sapiens
  Payload ID: 9442
  Gene Symbol: LARGE
  Gene Name: like-glycosyltransferase
  ENSP ID: ENSP00000415546
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKC

SEQ ID NO: 46625 - protein, 325 aa, Homo sapiens
  Payload ID: 9442
  Gene Symbol: LARGE
  Gene Name: like-glycosyltransferase
  ENSP ID: ENSP00000476364
LMGMLSTSLADQDIFNAVIKQNPFLVYQLPCFWNVQLSDHTRSEQCYRDVSDLKVIHWNSPKKLRVKNKHVEFFRNLYLTFLEYDGNLLRRELFGCPSEADVNSENLQKQLSELDEDDLCYEFRRERFTVHRTHLYFLHYEYEPAADSTDVTLVAQLSMDRLQMLEAICKHWEGPISLALYLSDAEAQQFLRYAQGSEVLMSRHNVGYHIVYKEGQFYPVNLLRNVAMKHISTPYMFLSDIDFLPMYGLYEYLRKSVIQLDLANTKKAMIVPAFETLRYRLSFPKSKAELLSMLDMGTLFTFSFDFSQTLSPIISCKTTVPNTCL

SEQ ID NO: 46626 - protein, 183 aa, Homo sapiens
  Payload ID: 9442
  Gene Symbol: LARGE
  Gene Name: like-glycosyltransferase
  ENSP ID: ENSP00000476415
LMGMLSTSLADQDIFNAVIKQNPFLVYQLPCFWNVQLSDHTRSEQCYRDVSDLKVIHWNSPKKLRVKNKHVEFFRNLYLTFLEYDGNLLRRELFGCPSEADVNSENLQKQLSELDEDDLCYEFRRERFTVHRTHLYFLHYEYEPAADSTDVTLVAQLSMDSFDFSQTLSPIISCKTTVPNTCL

SEQ ID NO: 46627 - protein, 276 aa, Homo sapiens
  Payload ID: 9442
  Gene Symbol: LARGE
  Gene Name: like-glycosyltransferase
  ENSP ID: ENSP00000476866
LMGMLSTSLADQDIFNAVIKQNPFLVYQLPCFWNVQLSDHTRSEQCYRDVSDLKVIHWNSPKKLRVKNKHVEFFRNLYLTFLEYDGNLLRRELFGCPSEADVNSENLQKQLSELDEDDLCYEFRRERFTVHRTHLYFLHYEYEPAADSTDVTLVAQLSMDRLQMLEAICKHWEGPISLALYLSDAEAQQFLRYAQGSEVLMSRHNVGYHIVYKEGQFYPVNLLRNVAMKHISTPYMFLSDIDFLPMYGLYEYLSFDFSQTLSPIISCKTTVPNTCL

SEQ ID NO: 46628 - protein, 1083 aa, Homo sapiens
  Payload ID: 9443
  Gene Symbol: LIMCH1
  Gene Name: LIM and calponin homology domains 1
  Uniprot ID: Q9UPQ0
  ENSP ID: ENSP00000316891
MACPALGLEALQPLQPEPPPEPAFSEAQKWIEQVTGRSFGDKDFRTGLENGILLCELLNAIKPGLVKKINRLPTPIAGLDNIILFLRGCKELGLKESQLFDPSDLQDTSNRVTVKSLDYSRKLKNVLVTIYWLGKAANSCTSYSGTTLNLKEFEGLLAQMRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPQFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKKSPREHFQAGPFSPCSPTPPGQSPNRSISGKKLCSSCGLPLGKGAAMIIETLNLYFHIQCFRCGICKGQLGDAVSGTDVRIRNGLLNCNDCYMRSRSAGQPTTL

SEQ ID NO: 46629 - protein, 890 aa, Homo sapiens
  Payload ID: 9443
  Gene Symbol: LIMCH1
  Gene Name: LIM and calponin homology domains 1
  Uniprot ID: Q9UPQ0
  ENSP ID: ENSP00000371172
MDSERQVKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRSTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 46630 - protein, 902 aa, Homo sapiens
  Payload ID: 9443
  Gene Symbol: LIMCH1
  Gene Name: LIM and calponin homology domains 1
  Uniprot ID: Q9UPQ0
  ENSP ID: ENSP00000379840
MDSERQVKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 46631 - protein, 126 aa, Homo sapiens
  Payload ID: 9443
  Gene Symbol: LIMCH1
  Gene Name: LIM and calponin homology domains 1
  ENSP ID: ENSP00000411020
MRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLR

SEQ ID NO: 46632 - protein, 897 aa, Homo sapiens
  Payload ID: 9443
  Gene Symbol: LIMCH1
  Gene Name: LIM and calponin homology domains 1
  Uniprot ID: Q9UPQ0
  ENSP ID: ENSP00000421242
MRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 46633 - protein, 917 aa, Homo sapiens
  Payload ID: 9443
  Gene Symbol: LIMCH1
  Gene Name: LIM and calponin homology domains 1
  ENSP ID: ENSP00000421656
  MOD_RES (1)..(1): Any amino acid
XIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKKSPREHFQAGPFSPCSPTPPGQSPNRSISGKKLCSSCGLPLGKGAAMIIETLNLYFHIQCFRCGICKGQLGDAVSGTDVRIRNGLLNCNDCYMRSRSAGQPTTL

SEQ ID NO: 46634 - protein, 916 aa, Homo sapiens
  Payload ID: 9443
  Gene Symbol: LIMCH1
  Gene Name: LIM and calponin homology domains 1
  ENSP ID: ENSP00000422864
MDSERQVKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRSTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKKSPREHFQAGPFSPCSPTPPGQSPNRSISGKKLCSSCGLPLGKGAAMIIETLNLYFHIQCFRCGICKGQLGDAVSGTDVRIRNGLLNCNDCYMRSRSAGQPTTL

SEQ ID NO: 46635 - protein, 160 aa, Homo sapiens
  Payload ID: 9443
  Gene Symbol: LIMCH1
  Gene Name: LIM and calponin homology domains 1
  ENSP ID: ENSP00000423355
MDSERQVKVKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFR

SEQ ID NO: 46636 - protein, 1069 aa, Homo sapiens
  Payload ID: 9443
  Gene Symbol: LIMCH1
  Gene Name: LIM and calponin homology domains 1
  Uniprot ID: Q9UPQ0
  ENSP ID: ENSP00000424437
MACPALGLEALQPLQPEPPPEPAFSEAQKWIEQVTGRSFGDKDFRTGLENGILLCELLNAIKPGLVKKINRLPTPIAGLDNIILFLRGCKELGLKESQLFDPSDLQDTSNRVTVKSLDYSRKLKNVLVTIYWLGKAANSCTSYSGTTLNLKEFEGLLAQMRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRSTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQESPGTASVPLRVQNSWRRSQFFSQSVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 46637 - protein, 1057 aa, Homo sapiens
  Payload ID: 9443
  Gene Symbol: LIMCH1
  Gene Name: LIM and calponin homology domains 1
  Uniprot ID: Q9UPQ0
  ENSP ID: ENSP00000424645
MACPALGLEALQPLQPEPPPEPAFSEAQKWIEQVTGRSFGDKDFRTGLENGILLCELLNAIKPGLVKKINRLPTPIAGLDNIILFLRGCKELGLKESQLFDPSDLQDTSNRVTVKSLDYSRKLKNVLVTIYWLGKAANSCTSYSGTTLNLKEFEGLLAQMRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPQFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 46638 - protein, 1056 aa, Homo sapiens
  Payload ID: 9443
  Gene Symbol: LIMCH1
  Gene Name: LIM and calponin homology domains 1
  Uniprot ID: Q9UPQ0
  ENSP ID: ENSP00000424825
MACPALGLEALQPLQPEPPPEPAFSEAQKWIEQVTGRSFGDKDFRTGLENGILLCELLNAIKPGLVKKINRLPTPIAGLDNIILFLRGCKELGLKESQLFDPSDLQDTSNRVTVKSLDYSRKLKNVLVTIYWLGKAANSCTSYSGTTLNLKEFEGLLAQMRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 46639 - protein, 910 aa, Homo sapiens
  Payload ID: 9443
  Gene Symbol: LIMCH1
  Gene Name: LIM and calponin homology domains 1
  Uniprot ID: Q9UPQ0
  ENSP ID: ENSP00000425222
MRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRSTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQESPGTASVPLRVQNSWRRSQFFSQSVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 46640 - protein, 1467 aa, Homo sapiens
  Payload ID: 9443
  Gene Symbol: LIMCH1
  Gene Name: LIM and calponin homology domains 1
  ENSP ID: ENSP00000425631
MRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFSFPETIEEEGSEVGSAGEDNPAGQMNPGWKPSDGGCELPDGSGKEHPSSDGAVVAPAPKSEEKDAAEIQKRKRLEQAGIKVMPAAQRFASQKQLSEEKEAIRDIVLRKENSFLTHQHGNDSEAEGEVVCRLPDLEKDDFAARRARMNQTKPMVPLNQLLYGPYPKKGAEKSDGSKQLSKGISKKRSLEYKRNQGHTEEVKLIVTCNMRAQESEPVEGGLRKVPDLHKDDLAQQRIQGSLAPHREPPSFITLSNITEADLETWERLKVSEKARDGDVQHICASEPSPEIKAETAIRDDFANRKARASKKASSPRQKFVHFGPVTELDQQKWKRLSIGKAGPREDEEEVICHGSKIQMDSVSPVSAATSSLKGHQIFNRQNDCRTMNCGRGDYCRRASWLAPVPESQEEWVCSLGECPRGTEEVTSKQLPQDGKEETESAPRDSERLSKAERSEDSSQPLVCPLASECEASGTEEKLEKMTAPAWSGSGLKGQRKLDDSRKDDMMARRTGMSLRHTGSNPNQFLPVPFAKQQDVEESSKGLPMKDQRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKKSPREHFQAGPFSPCSPTPPGQSPNRSISGKKLCSSCGLPLGKGAAMIIETLNLYFHIQCFRCGICKGQLGDAVSGTDVRIRNGLLNCNDCYMRSRSAGQPTTL

SEQ ID NO: 46641 - protein, 897 aa, Homo sapiens
  Payload ID: 9443
  Gene Symbol: LIMCH1
  Gene Name: LIM and calponin homology domains 1
  ENSP ID: ENSP00000426334
MLRHWREQGFYYNTRDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRSTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKVVKPKSPEPEATLTFPFLDKMPEANQLHLPNLNSQVDSPSSEKSPVMTPFKFWAWDPEEERRRQEKWQQEQERLLQERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 46642 - protein, 26 aa, Homo sapiens
  Payload ID: 9443
  Gene Symbol: LIMCH1
  Gene Name: LIM and calponin homology domains 1
  ENSP ID: ENSP00000426353
MRKDTDDIESPKRSIRDSGYIDCWDS

SEQ ID NO: 46643 - protein, 980 aa, Homo sapiens
  Payload ID: 9443
  Gene Symbol: LIMCH1
  Gene Name: LIM and calponin homology domains 1
  ENSP ID: ENSP00000427045
MACPALGLEALQPLQPEPPPEPAFSEAQKWIEQVTGRSFGDKDFRTGLENGILLCELLNAIKPGLVKKINRLPTPIAGLDNIILFLRGCKELGLKESQLFDPSDLQDTSNRVTVKSLDYSRKLKNVLVTIYWLGKAANSCTSYSGTTLNLKEFEGLLAQMRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFRYGPRTPVSDDAESTSMFDMRCEEEAAVQPHSRARQEQLQLINNQLREEDDKWQDDLARWKSRRRSVSQDLIKKEEERKKMEKLLAGEDGTSERRKSIKTYREIVQEKERRERELHEAYKNARSQEEAEGILQQYIERFTISEAVLERLEMPKILERSHSTEPNLSSFLNDPNPMKYLRQQSLPPPKFTATVETTIARASVLDTSMSAGSGSPSKTVTPKAVPMLTPKPYSQPKNSQDVLKTFKVDGKVSVNGETVHREEEKERECPTVAPAHSLTKSQMFEGVARVHGSPLELKQDNGSIEINIKKPNSVPQELAATTEKTEPNSQEDKNDGGKSRKGNIELASSEPQHFTTTVTRCSPTVAFVEFPSSPQLKNDVSEEKDQKKPENEMSGKVELVLSQKERYQKEQDKLKEEWEKAQKEVEEEERRYYEEERKIIEDTVVPFTVSSSSADQLSTSSSMTEGSGTMNKIDLGNCQDEKQDRRWKKSFQGDDSDLLLKTRESDRLEEKGSLTEGALAHSGNPVSKGVHEDHQLDTEAGAPHCGTNPQLAQDPSQNQQTSNPTHSSEDVKPKTLPLDKSINHQIESPSERRKSISGKKLCSSCGLPLGKGAAMIIETLNLYFHIQCFRCGICKGQLGDAVSGTDVRIRNGLLNCNDCYMRSRSAGQPTTL

SEQ ID NO: 46644 - protein, 153 aa, Homo sapiens
  Payload ID: 9443
  Gene Symbol: LIMCH1
  Gene Name: LIM and calponin homology domains 1
  ENSP ID: ENSP00000427311
MRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEREEYRKSWSTATSPLGGERPFR

SEQ ID NO: 46645 - protein, 365 aa, Homo sapiens
  Payload ID: 9444
  Gene Symbol: LMCD1
  Gene Name: LIM and cysteine-rich domains 1
  Uniprot ID: Q9NZU5
  ENSP ID: ENSP00000157600
MAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 46646 - protein, 253 aa, Homo sapiens
  Payload ID: 9444
  Gene Symbol: LMCD1
  Gene Name: LIM and cysteine-rich domains 1
  ENSP ID: ENSP00000380542
MFGMQGDVFGLRATFMEGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 46647 - protein, 292 aa, Homo sapiens
  Payload ID: 9444
  Gene Symbol: LMCD1
  Gene Name: LIM and cysteine-rich domains 1
  Uniprot ID: Q9NZU5
  ENSP ID: ENSP00000396515
MDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 46648 - protein, 233 aa, Homo sapiens
  Payload ID: 9444
  Gene Symbol: LMCD1
  Gene Name: LIM and cysteine-rich domains 1
  ENSP ID: ENSP00000400555
MGYTYKVIERILEIGAFRPHMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAAT

SEQ ID NO: 46649 - protein, 58 aa, Homo sapiens
  Payload ID: 9444
  Gene Symbol: LMCD1
  Gene Name: LIM and cysteine-rich domains 1
  ENSP ID: ENSP00000405049
MAKVAKDLNPGVKKMSLGQLQSARGVACLGCKGTCSGFEPHSWRDCSTWSSSPRRSSQ

SEQ ID NO: 46650 - protein, 247 aa, Homo sapiens
  Payload ID: 9444
  Gene Symbol: LMCD1
  Gene Name: LIM and cysteine-rich domains 1
  ENSP ID: ENSP00000411222
MAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYKPVPLV

SEQ ID NO: 46651 - protein, 325 aa, Homo sapiens
  Payload ID: 9445
  Gene Symbol: LIMS1
  Gene Name: LIM and senescent cell antigen-like domains 1
  Uniprot ID: P48059
  ENSP ID: ENSP00000331775
MANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 46652 - protein, 387 aa, Homo sapiens
  Payload ID: 9445
  Gene Symbol: LIMS1
  Gene Name: LIM and senescent cell antigen-like domains 1
  Uniprot ID: P48059
  ENSP ID: ENSP00000337598
MAFSGRARPCIIPENEEIPRAALNTVHEANGTEDERAVSKLQRRHSDVKVYKEFCDFYAKFNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 46653 - protein, 325 aa, Homo sapiens; identical to SEQ ID NO: 46651
  Payload ID: 9445
  Gene Symbol: LIMS1
  Gene Name: LIM and senescent cell antigen-like domains 1
  Uniprot ID: P48059
  ENSP ID: ENSP00000376987

SEQ ID NO: 46654 - protein, 329 aa, Homo sapiens
  Payload ID: 9445
  Gene Symbol: LIMS1
  Gene Name: LIM and senescent cell antigen-like domains 1
  Uniprot ID: P48059
  ENSP ID: ENSP00000386926
MTCNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 46655 - protein, 362 aa, Homo sapiens
  Payload ID: 9445
  Gene Symbol: LIMS1
  Gene Name: LIM and senescent cell antigen-like domains 1
  Uniprot ID: P48059
  ENSP ID: ENSP00000387264
MTALQLKELSHSGLYRRRRDRPDSLRVNGLPEEELSNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 46656 - protein, 176 aa, Homo sapiens
  Payload ID: 9445
  Gene Symbol: LIMS1
  Gene Name: LIM and senescent cell antigen-like domains 1
  ENSP ID: ENSP00000390862
MLGVAAGMTHSNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANC

SEQ ID NO: 46657 - protein, 117 aa, Homo sapiens
  Payload ID: 9445
  Gene Symbol: LIMS1
  Gene Name: LIM and senescent cell antigen-like domains 1
  ENSP ID: ENSP00000399267
MAFSGRARPCIIPENEEIPRAALNTVHEANGTEDERAVSKLQRRHSDVKVYKEFCDFYAKFNMANALASATCERCKGGFAPAEKIVNSNGELYHEQCFVCAQCFQQFPEGLFYEERT

SEQ ID NO: 46658 - protein, 100 aa, Homo sapiens
  Payload ID: 9445
  Gene Symbol: LIMS1
  Gene Name: LIM and senescent cell antigen-like domains 1
  ENSP ID: ENSP00000402322
MTALQLKELSHSGLYRRRRDRPDSLRVNGLPEEELSNMANALASATCERCKGGFAPAEKIVNSNGELYHEQCFVCAQCFQQFPEGLFYEVNSSLAELSKP

SEQ ID NO: 46659 - protein, 55 aa, Homo sapiens
  Payload ID: 9445
  Gene Symbol: LIMS1
  Gene Name: LIM and senescent cell antigen-like domains 1
  ENSP ID: ENSP00000410751
MANALASATCERCKGGFAPAEKIVNSNGELYHEQCFVCAQCFQQFPEGLFYEERT

SEQ ID NO: 46660 - protein, 337 aa, Homo sapiens
  Payload ID: 9445
  Gene Symbol: LIMS1
  Gene Name: LIM and senescent cell antigen-like domains 1
  Uniprot ID: P48059
  ENSP ID: ENSP00000437912
MLGVAAGMTHSNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 46661 - protein, 209 aa, Homo sapiens
  Payload ID: 9445
  Gene Symbol: LIMS1
  Gene Name: LIM and senescent cell antigen-like domains 1
  ENSP ID: ENSP00000446121
  MOD_RES (1)..(1): Any amino acid
XKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKDKFVEIDLKPVCKHCYEKMPEEFKRRLAKREREAKDKDKQKKKKPVCLNKFVEFDMKPVCKKCYEKFPLELKKRLKKLAETLGRK

SEQ ID NO: 46662 - protein, 365 aa, Homo sapiens
  Payload ID: 9446
  Gene Symbol: LIMS2
  Gene Name: LIM and senescent cell antigen-like domains 2
  Uniprot ID: Q7Z4I7
  ENSP ID: ENSP00000326888
MAARLGALAASGLYRRRQHRQSPPPATGNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 46663 - protein, 341 aa, Homo sapiens
  Payload ID: 9446
  Gene Symbol: LIMS2
  Gene Name: LIM and senescent cell antigen-like domains 2
  Uniprot ID: Q7Z4I7
  ENSP ID: ENSP00000347240
MTGSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 46664 - protein, 189 aa, Homo sapiens
  Payload ID: 9446
  Gene Symbol: LIMS2
  Gene Name: LIM and senescent cell antigen-like domains 2
  Uniprot ID: Q7Z4I7
  ENSP ID: ENSP00000386252
MFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 46665 - protein, 189 aa, Homo sapiens; identical to SEQ ID NO: 46664
  Payload ID: 9446
  Gene Symbol: LIMS2
  Gene Name: LIM and senescent cell antigen-like domains 2
  Uniprot ID: Q7Z4I7
  ENSP ID: ENSP00000386345

SEQ ID NO: 46666 - protein, 336 aa, Homo sapiens
  Payload ID: 9446
  Gene Symbol: LIMS2
  Gene Name: LIM and senescent cell antigen-like domains 2
  Uniprot ID: Q7Z4I7
  ENSP ID: ENSP00000386383
MSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 46667 - protein, 189 aa, Homo sapiens; identical to SEQ ID NO: 46664
  Payload ID: 9446
  Gene Symbol: LIMS2
  Gene Name: LIM and senescent cell antigen-like domains 2
  Uniprot ID: Q7Z4I7
  ENSP ID: ENSP00000386570

SEQ ID NO: 46668 - protein, 336 aa, Homo sapiens; identical to SEQ ID NO: 46666
  Payload ID: 9446
  Gene Symbol: LIMS2
  Gene Name: LIM and senescent cell antigen-like domains 2
  Uniprot ID: Q7Z4I7
  ENSP ID: ENSP00000386637

SEQ ID NO: 46669 - protein, 189 aa, Homo sapiens; identical to SEQ ID NO: 46664
  Payload ID: 9446
  Gene Symbol: LIMS2
  Gene Name: LIM and senescent cell antigen-like domains 2
  Uniprot ID: Q7Z4I7
  ENSP ID: ENSP00000386907

SEQ ID NO: 46670 - protein, 336 aa, Homo sapiens; identical to SEQ ID NO: 46666
  Payload ID: 9446
  Gene Symbol: LIMS2
  Gene Name: LIM and senescent cell antigen-like domains 2
  Uniprot ID: Q7Z4I7
  ENSP ID: ENSP00000387002

SEQ ID NO: 46671 - protein, 60 aa, Homo sapiens
  Payload ID: 9446
  Gene Symbol: LIMS2
  Gene Name: LIM and senescent cell antigen-like domains 2
  ENSP ID: ENSP00000388611
MFRSDAYHPDHFNCTHCGTLSVPSVRSHSWGTGTMRRRAWPTARLTTTSSSGTSATTAAM

SEQ ID NO: 46672 - protein, 169 aa, Homo sapiens
  Payload ID: 9446
  Gene Symbol: LIMS2
  Gene Name: LIM and senescent cell antigen-like domains 2
  ENSP ID: ENSP00000397253
  MOD_RES (1)..(1): Any amino acid
XGVPICGACRRPIEGRVVNALGKQWHVEVSQAGGHVASGWGVPQLRVMHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 46673 - protein, 363 aa, Homo sapiens
  Payload ID: 9446
  Gene Symbol: LIMS2
  Gene Name: LIM and senescent cell antigen-like domains 2
  Uniprot ID: Q7Z4I7
  ENSP ID: ENSP00000443794
MTGRKRKWGETGTGSGAAPAAALRWSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 46674 - protein, 249 aa, Homo sapiens
  Payload ID: 9446
  Gene Symbol: LIMS2
  Gene Name: LIM and senescent cell antigen-like domains 2
  ENSP ID: ENSP00000484949
MESRHPAVAEIACTCWALLHLANPEGRGHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 46675 - protein, 117 aa, Homo sapiens
  Payload ID: 9447
  Gene Symbol: LIMS3
  Gene Name: LIM and senescent cell antigen-like domains 3
  Uniprot ID: P0CW19
  ENSP ID: ENSP00000405165
MAFSGRARPCIIPENEEIPRAALNTVHEANGTEDERAVSKLQRRHSDVKVYKEFCDFYAKFNMANALASATCERCKGGFAPAETIVNSNGELYHEQCFVCAQCFQQFPEGLFYEERT

SEQ ID NO: 46676 - protein, 248 aa, Homo sapiens; identical to SEQ ID NO: 1146
  Payload ID: 9447
  Gene Symbol: LIMS3
  Gene Name: LIM and senescent cell antigen-like domains 3
  Uniprot ID: P0CW19
  ENSP ID: ENSP00000488227

SEQ ID NO: 46677 - protein, 398 aa, Homo sapiens
  Payload ID: 9447
  Gene Symbol: LIMS3
  Gene Name: LIM and senescent cell antigen-like domains 3
  ENSP ID: ENSP00000488486
MAFSGRARPCIIPENEEIPRAALNTVHEANGTEDERAVSKLQRRHSDVKVYKEFCDFYAKFNMANALASATCERCKGGFAPAETIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKDLTADAQELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKDKFVEIDLKPVCKHCYEKMPEEFKRRLAKREREAKDKDKQKKKKPVCL

SEQ ID NO: 46678 - protein, 55 aa, Homo sapiens
  Payload ID: 9447
  Gene Symbol: LIMS3
  Gene Name: LIM and senescent cell antigen-like domains 3
  ENSP ID: ENSP00000488782
MANALASATCERCKGGFAPAETIVNSNGELYHEQCFVCAQCFQQFPEGLFYEERT

SEQ ID NO: 46679 - protein, 117 aa, Homo sapiens; identical to SEQ ID NO: 46675
  Payload ID: 9448
  Gene Symbol: LIMS3L
  Gene Name: LIM and senescent cell antigen-like domains 3-like
  Uniprot ID: P0CW20
  ENSP ID: ENSP00000404432

SEQ ID NO: 46680 - protein, 248 aa, Homo sapiens; identical to SEQ ID NO: 1146
  Payload ID: 9448
  Gene Symbol: LIMS3L
  Gene Name: LIM and senescent cell antigen-like domains 3-like
  ENSP ID: ENSP00000487960

SEQ ID NO: 46681 - protein, 398 aa, Homo sapiens; identical to SEQ ID NO: 46677
  Payload ID: 9448
  Gene Symbol: LIMS3L
  Gene Name: LIM and senescent cell antigen-like domains 3-like
  ENSP ID: ENSP00000488340

SEQ ID NO: 46682 - protein, 261 aa, Homo sapiens
  Payload ID: 9449
  Gene Symbol: LASP1
  Gene Name: LIM and SH3 protein 1
  Uniprot ID: Q14847
  ENSP ID: ENSP00000325240
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGKRYRAVYDYSAADEDEVSFQDGDTIVNVQQIDDGWMYGTVERTGDTGMLPANYVEAI

SEQ ID NO: 46683 - protein, 166 aa, Homo sapiens
  Payload ID: 9449
  Gene Symbol: LASP1
  Gene Name: LIM and SH3 protein 1
  ENSP ID: ENSP00000391897
MTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGG

SEQ ID NO: 46684 - protein, 261 aa, Homo sapiens; identical to SEQ ID NO: 46682
  Payload ID: 9449
  Gene Symbol: LASP1
  Gene Name: LIM and SH3 protein 1
  Uniprot ID: Q14847
  ENSP ID: ENSP00000392853

SEQ ID NO: 46685 - protein, 205 aa, Homo sapiens
  Payload ID: 9449
  Gene Symbol: LASP1
  Gene Name: LIM and SH3 protein 1
  Uniprot ID: Q14847
  ENSP ID: ENSP00000401048
MLPLRDLQDDTEHEELQGLREEALLQRVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGKRYRAVYDYSAADEDEVSFQDGDTIVNVQQIDDGWMYGTVERTGDTGMLPANYVEAI

SEQ ID NO: 46686 - protein, 91 aa, Homo sapiens
  Payload ID: 9449
  Gene Symbol: LASP1
  Gene Name: LIM and SH3 protein 1
  ENSP ID: ENSP00000414803
MNPNCARCGKIVYPTEKVNCLDKFWHKACFHCETCKMTLNMKNYKGYEKKPYCNAHYPKQSFTMVADTPENLRLKQQSELQSQMKKPRPGA

SEQ ID NO: 46687 - protein, 105 aa, Homo sapiens
  Payload ID: 9449
  Gene Symbol: LASP1
  Gene Name: LIM and SH3 protein 1
  ENSP ID: ENSP00000462564
RDSQDGSSYRRPLEQQQPHHIPTSAPVYQQPQQQPVAQSYGGYKEPAAPVSIQRSAPGGGGVSNPGRRGEARGRGSFGKAWTQLMDSPDLCTHPLLCVMIRISAL

SEQ ID NO: 46688 - protein, 71 aa, Homo sapiens
  Payload ID: 9449
  Gene Symbol: LASP1
  Gene Name: LIM and SH3 protein 1
  ENSP ID: ENSP00000468664
MNPNCARCGKIVYPTEKVNCLDKFWHKACFHCETCKMTLNMKNYKGYEKKPYCNACATRRSLRRTRAKVSA

SEQ ID NO: 46689 - protein, 1398 aa, Homo sapiens
  Payload ID: 9450
  Gene Symbol: LMO7
  Gene Name: LIM domain 7
  ENSP ID: ENSP00000317802
MQDYNKDDMSYRRISAVEPKTALPFNRFLPNKSRQPSYVPAPLRKKKPDKHEDNRRSWASPVYTEADGTFSSNQRRIWGTNVENWPTVQGTSKSSCYLEEEKAKTRSIPNIVKDDLYVRKLSPVMPNPGNAFDQFLPKCWTPEDVNWKRIKRETYKPWYKEFQGFSQFLLLQALQTYSDDILSSETHTKIDPTSGPRLITRRKNLSYAPGYRRDDLEMAALDPDLENDDFFVRKTGAFHANPYVLRAFEDFRKFSEQDDSVERDIILQCREGELVLPDLEKDDMIVRRIPAQKKEVPLSGAPDRYHPVPFPEPWTLPPEIQAKFLCVLERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 46690 - protein, 1349 aa, Homo sapiens
  Payload ID: 9450
  Gene Symbol: LMO7
  Gene Name: LIM domain 7
  Uniprot ID: Q8WWI1
  ENSP ID: ENSP00000342112
MKKIRICHIFTFYSWMSYDVLFQRTELGALEIWRQLICAHVCICVGWLYLRDRVCSKKDIILRTEQNSGRTILIKAVTEKNFETKDFRASLENGVLLCDLINKLKPGVIKKINRLSTPIAGLDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSRLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 46691 - protein, 1668 aa, Homo sapiens
  Payload ID: 9450
  Gene Symbol: LMO7
  Gene Name: LIM domain 7
  ENSP ID: ENSP00000349571
MSYDVLFQRTELGALEIWRQLICAHVCICVGWLYLRDRVCSKKDIILRTEQNSGRTILIKAVTEKNFETKDFRASLENGVLLCDLINKLKPGVIKKINRLSTPIAGLDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSSNQRRIWGTNVENWPTVQGTSKSSCYLEEEKAKTRSIPNIVKDDLYVRKLSPVMPNPGNAFDQFLPKCWTPEDVNWKRIKRETYKPWYKEFQGFSQFLLLQALQTYSDDILSSETHTKIDPTSGPRLITRRKNLSYAPGYRRDDLEMAALDPDLENDDFFVRKTGAFHANPYVLRAFEDFRKFSEQDDSVERDIILQCREGELVLPDLEKDDMIVRRIPAQKKEVPLSGAPDRYHPVPFPEPWTLPPEIQAKFLCVLERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 46692 - protein, 1045 aa, Homo sapiens
  Payload ID: 9450
  Gene Symbol: LMO7
  Gene Name: LIM domain 7
  ENSP ID: ENSP00000366719
MEGLEEAEANCSVAFAEAQRWVEAVTEKNFETKDFRASLENGVLLCDLINKLKPGVIKKINRLSTPIAGLDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSRLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYS

SEQ ID NO: 46693 - protein, 1631 aa, Homo sapiens
  Payload ID: 9450
  Gene Symbol: LMO7
  Gene Name: LIM domain 7
  ENSP ID: ENSP00000366757
MEGLEEAEANCSVAFAEAQRWVEAVTEKNFETKDFRASLENGVLLCDLINKLKPGVIKKINRLSTPIAGLDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSSNQRRIWGTNVENWPTVQGTSKSSCYLEEEKAKTRSIPNIVKDDLYVRKLSPVMPNPGNAFDQFLPKCWTPEDVNWKRIKRETYKPWYKEFQGFSQFLLLQALQTYSDDILSSETHTKIDPTSGPRLITRRKNLSYAPGYRRDDLEMAALDPDLENDDFFVRKTGAFHANPYVLRAFEDFRKFSEQDDSVERDIILQCREGELVLPDLEKDDMIVRRIPAQKKEVPLSGAPDRYHPVPFPEPWTLPPEIQAKFLCVLERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 46694 - protein, 1055 aa, Homo sapiens
  Payload ID: 9450
  Gene Symbol: LMO7
  Gene Name: LIM domain 7
  ENSP ID: ENSP00000388955
  MOD_RES (1)..(1): Any amino acid
XFKMQDYNKDDMSYRRISAVEPKTALPFNRFLPNKSRQPSYVPAPLRKKKPDKHEDNRRSWASPVYTEADGTFSSQFLLLQALQTYSDDILSSETHTKIDPTSGPRLITRRKNLSYAPGYRRDDLEMAALDPDLENDDFFVRKTGAFHANPYVLRAFEDFRKFSEQDDSVERDIILQCREGELVLPDLEKDDMIVRRIPAQKKEVPLSGAPDRYHPVPFPEPWTLPPEIQAKFLCVLERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYS

SEQ ID NO: 46695 - protein, 1275 aa, Homo sapiens
  Payload ID: 9450
  Gene Symbol: LMO7
  Gene Name: LIM domain 7
  ENSP ID: ENSP00000431129
MLWRTERLYKPYVFFFKYTYAWVLLLPLLLTDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSRSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKADWGKDQPSLPFIRHKTLNLTSMATKIIGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 46696 - protein, 121 aa, Homo sapiens
  Payload ID: 9450
  Gene Symbol: LMO7
  Gene Name: LIM domain 7
  ENSP ID: ENSP00000431271
MQDYNKDDMSYRRISAVEPKTALPFNRFLPNKSRQPSYVPAPLRKKKPDKHEDNRRSWASPVYTEADGTFSRLFQKIYGENGSKSMSDVSAEDVQNLRQLRYEEMQKIKSQLKEQDQKWQD

SEQ ID NO: 46697 - protein, 165 aa, Homo sapiens
  Payload ID: 9450
  Gene Symbol: LMO7
  Gene Name: LIM domain 7
  ENSP ID: ENSP00000431636
MQDYNKDDMSYRRISAVEPKTALPFNRFLPNKSRQPSYVPAPLRKKKPDKHEDNRRSWASPVYTEADGTFSRLFQKIYGENGSKSMSDVSAEDVQNLRQLRYEEMQKIKSQLKEQDQKWQDDLAKWKDRRKSYTSDLQKKKEEREEIEKQALEKSKRSSKTFKEM

SEQ ID NO: 46698 - protein, 191 aa, Homo sapiens
  Payload ID: 9450
  Gene Symbol: LMO7
  Gene Name: LIM domain 7
  ENSP ID: ENSP00000431896
MQDYNKDDMSYRRISAVEPKTALPFNRFLPNKSRQPSYVPAPLRKKKPDKHEDNRRSWASPVYTEADGTFSRSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMT

SEQ ID NO: 46699 - protein, 165 aa, Homo sapiens
  Payload ID: 9450
  Gene Symbol: LMO7
  Gene Name: LIM domain 7
  ENSP ID: ENSP00000432269
MQDYNKDDMSYRRISAVEPKTALPFNRFLPNKSRQPSYVPAPLRKKKPDKHEDNRRSWASPVYTEADGTFSSNQRRIWGTNVENWPTVQGTSKSSCYLEEEKAKTRSIPNIVKDDLYVRKLSPVMPNPGNAFDQFLPKCWTPEDVNWKRIKRETYKPWYKEFQGF

SEQ ID NO: 46700 - protein, 1385 aa, Homo sapiens
  Payload ID: 9450
  Gene Symbol: LMO7
  Gene Name: LIM domain 7
  ENSP ID: ENSP00000433352
MQDYNKDDMSYRRISAVEPKTALPFNRFLPNKSRQPSYVPAPLRKKKPDKHEDNRRSWASPVYTEADGTFSSNQRRIWGTNVENWPTVQGTSKSSCYLEEEKAKTRSIPNIVKDDLYVRKLSPVMPNPGNAFDQFLPKCWTPEDVNWKRIKRETYKPWYKEFQGFSQFLLLQALQTYSDDILSSETHTKIDPTSGPRLITRRKNLSYAPGYRRDDLEMAALDPDLENDDFFVRKTGAFHANPYVLRAFEDFRKFSEQDDSVERDIILQCREGELVLPDLEKDDMIVRRIPAQKKEVPLSGAPDRYHPVPFPEPWTLPPEIQAKFLCVLERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNSVLPVSVTSEALPQELKSGSETTNCTATTAISDSNLDGQPPCDVSLHTKALLQIEEEVVAAHVDL

SEQ ID NO: 46701 - protein, 305 aa, Homo sapiens
  Payload ID: 9450
  Gene Symbol: LMO7
  Gene Name: LIM domain 7
  ENSP ID: ENSP00000433591
  MOD_RES (1)..(1): Any amino acid
XDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKADWGKDQPSLPFIRHKTLNLTSMATKIIGSPETKWIDATSGIYNSEKSSNLSVTTDFSESLQSSNIESKEINGIHDESNAFESKGSSDSVVPDLPVPTISAPSRWVWDQEEERKRQERWQKEQDRLLQEKYQREQEKLREEWQRAKQEAERENSKYLDE

SEQ ID NO: 46702 - protein, 292 aa, Homo sapiens
  Payload ID: 9450
  Gene Symbol: LMO7
  Gene Name: LIM domain 7
  ENSP ID: ENSP00000434083
  MOD_RES (1)..(1): Any amino acid
XNDSKEWEEAMAKAQETGHLVMDVRRYGKAGSPETKWIDATSGIYNSEKSSNLSVTTDFSESLQSSNIESKEINGIHDESNAFESKGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEE

SEQ ID NO: 46703 - protein, 141 aa, Homo sapiens
  Payload ID: 9450
  Gene Symbol: LMO7
  Gene Name: LIM domain 7
  ENSP ID: ENSP00000434201
MQDYNKDDMSYRRISAVEPKTALPFNRFLPNKSRQPSYVPAPLRKKKPDKHEDNRRSWASPVYTEADGTFSSQFLLLQALQTYSDDILSSETHTKIDPTSGPRLITRRKNLSYAPGYRRDDLEMAALDPDLENDDFFVRKT

SEQ ID NO: 46704 - protein, 12 aa, Homo sapiens
  Payload ID: 9450
  Gene Symbol: LMO7
  Gene Name: LIM domain 7
  ENSP ID: ENSP00000434943
MQDYNKDDMSYR

SEQ ID NO: 46705 - protein, 179 aa, Homo sapiens
  Payload ID: 9450
  Gene Symbol: LMO7
  Gene Name: LIM domain 7
  ENSP ID: ENSP00000435296
  MOD_RES (1)..(1): Any amino acid
XTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSGFSYSSWVYLCGSSDSVVPD

SEQ ID NO: 46706 - protein, 99 aa, Homo sapiens
  Payload ID: 9450
  Gene Symbol: LMO7
  Gene Name: LIM domain 7
  ENSP ID: ENSP00000475811
MIEVSERNYFIEMKTYIVYFSSLPMCCNTGSSDSVVPDLPVPTISAPSRWVWDQEEERKRQERWQKEQDRLLQEKYQREQEKLREEWQRAKQEAERENS

SEQ ID NO: 46707 - protein, 759 aa, Homo sapiens
  Payload ID: 9451
  Gene Symbol: LIMA1
  Gene Name: LIM domain and actin binding 1
  Uniprot ID: Q9UHB6
  ENSP ID: ENSP00000340184
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSHAASGAKADQEEQIHPRSRLRSPPEALVQGRYPHIKDGEDLKDHSTESKKMENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 46708 - protein, 760 aa, Homo sapiens
  Payload ID: 9451
  Gene Symbol: LIMA1
  Gene Name: LIM domain and actin binding 1
  Uniprot ID: Q9UHB6
  ENSP ID: ENSP00000378400
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSHAASGAKADQEEQIHPRSRLRSPPEALVQGRYPHIKDGEDLKDHSTESKKMENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSPGDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 46709 - protein, 130 aa, Homo sapiens
  Payload ID: 9451
  Gene Symbol: LIMA1
  Gene Name: LIM domain and actin binding 1
  ENSP ID: ENSP00000447975
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSHAASGAKADQEEQIHPRSRL

SEQ ID NO: 46710 - protein, 388 aa, Homo sapiens
  Payload ID: 9451
  Gene Symbol: LIMA1
  Gene Name: LIM domain and actin binding 1
  ENSP ID: ENSP00000448411
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSHAASGAKADQEEQIHPRSRLRSPPEALVQGRYPHIKDGEDLKDHSTESKKMENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKLLPPAPGT

SEQ ID NO: 46711 - protein, 456 aa, Homo sapiens
  Payload ID: 9451
  Gene Symbol: LIMA1
  Gene Name: LIM domain and actin binding 1
  ENSP ID: ENSP00000448463
MEQKENVPPGPEVCITHQEGEKISANENSLAVRSTPAEDDSRDSQVKSEVQQPVHPKPLSPDSRASSLSESSPPKAMKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 46712 - protein, 457 aa, Homo sapiens
  Payload ID: 9451
  Gene Symbol: LIMA1
  Gene Name: LIM domain and actin binding 1
  Uniprot ID: Q9UHB6
  ENSP ID: ENSP00000448706
MEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 46713 - protein, 600 aa, Homo sapiens
  Payload ID: 9451
  Gene Symbol: LIMA1
  Gene Name: LIM domain and actin binding 1
  Uniprot ID: Q9UHB6
  ENSP ID: ENSP00000448779
MENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSPGDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 46714 - protein, 111 aa, Homo sapiens
  Payload ID: 9451
  Gene Symbol: LIMA1
  Gene Name: LIM domain and actin binding 1
  ENSP ID: ENSP00000449890
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSH

SEQ ID NO: 46715 - protein, 598 aa, Homo sapiens
  Payload ID: 9451
  Gene Symbol: LIMA1
  Gene Name: LIM domain and actin binding 1
  ENSP ID: ENSP00000450087
MENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 46716 - protein, 599 aa, Homo sapiens
  Payload ID: 9451
  Gene Symbol: LIMA1
  Gene Name: LIM domain and actin binding 1
  Uniprot ID: Q9UHB6
  ENSP ID: ENSP00000450266
MENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 46717 - protein, 375 aa, Homo sapiens
  Payload ID: 9452
  Gene Symbol: LDB1
  Gene Name: LIM domain binding 1
  Uniprot ID: Q86U70
  ENSP ID: ENSP00000354616
MLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSPASTFALSSQVPDVMVVGEPTLMGGEFGDEDERLITRLENTQFDAANGIDDEDSFNNSPALGANSPWNSKPPSSQESKSENPTSQASQ

SEQ ID NO: 46718 - protein, 411 aa, Homo sapiens
  Payload ID: 9452
  Gene Symbol: LDB1
  Gene Name: LIM domain binding 1
  Uniprot ID: Q86U70
  ENSP ID: ENSP00000392466
MSVGCACPGCSSKSFKLYSPKEPPNGNAFPPFHPGTMLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSPASTFALSSQVPDVMVVGEPTLMGGEFGDEDERLITRLENTQFDAANGIDDEDSFNNSPALGANSPWNSKPPSSQESKSENPTSQASQ

SEQ ID NO: 46719 - protein, 373 aa, Homo sapiens
  Payload ID: 9453
  Gene Symbol: LDB2
  Gene Name: LIM domain binding 2
  Uniprot ID: O43679
  ENSP ID: ENSP00000306772
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPDVMVVGEPTLMGGEFGDEDERLITRLENTQYDAANGMDDEEDFNNSPALGNNSPWNSKPPATQETKSENPPPQASQ

SEQ ID NO: 46720 - protein, 331 aa, Homo sapiens
  Payload ID: 9453
  Gene Symbol: LDB2
  Gene Name: LIM domain binding 2
  Uniprot ID: O43679
  ENSP ID: ENSP00000392089
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPGLGAIPNCSLNPGRDGDLCHSTAVTPSGQFKEKH

SEQ ID NO: 46721 - protein, 164 aa, Homo sapiens
  Payload ID: 9453
  Gene Symbol: LDB2
  Gene Name: LIM domain binding 2
  ENSP ID: ENSP00000421767
MVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLS

SEQ ID NO: 46722 - protein, 371 aa, Homo sapiens
  Payload ID: 9453
  Gene Symbol: LDB2
  Gene Name: LIM domain binding 2
  ENSP ID: ENSP00000422552
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQDVMVVGEPTLMGGEFGDEDERLITRLENTQYDAANGMDDEEDFNNSPALGNNSPWNSKPPATQETKSENPPPQASQ

SEQ ID NO: 46723 - protein, 313 aa, Homo sapiens
  Payload ID: 9453
  Gene Symbol: LDB2
  Gene Name: LIM domain binding 2
  ENSP ID: ENSP00000423963
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPIASIARSPVSGCALRT

SEQ ID NO: 46724 - protein, 106 aa, Homo sapiens
  Payload ID: 9453
  Gene Symbol: LDB2
  Gene Name: LIM domain binding 2
  ENSP ID: ENSP00000424676
MSSTPHDPFYSSPFGPFYRRHTPYMVQPEYRIYEMNKRLQSRTEDSDNLWWDAFATEFFEDDATLTLSFCLEDGPKRYRTKNLRPIGEKMNINGKCYRQDPHPPLL

SEQ ID NO: 46725 - protein, 110 aa, Homo sapiens
  Payload ID: 9453
  Gene Symbol: LDB2
  Gene Name: LIM domain binding 2
  ENSP ID: ENSP00000424770
MSSTPHDPFYSSPFGPFYRRHTPYMVQPEYRIYEMNKRLQSRTEDSDNLWWDAFATEFFEDDATLTLSFCLEDGPKRYIVHSAADARGNCNQLGDSEPDACDGLLQFPIM

SEQ ID NO: 46726 - protein, 294 aa, Homo sapiens
  Payload ID: 9453
  Gene Symbol: LDB2
  Gene Name: LIM domain binding 2
  ENSP ID: ENSP00000425754
  MOD_RES (1)..(1): Any amino acid
XIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPEPTRQPTTKRRKRKNSTSSTSNSSAGNNANSTGSKKKTTAANLSLSSQVPDVMVVGEPTLMGGEFGDEDERLITRLENTQYDAANGMDDEEDFNNSPALGNNSPWNSKPPATQETKSENPPPQASQ

SEQ ID NO: 46727 - protein, 617 aa, Homo sapiens
  Payload ID: 9454
  Gene Symbol: LDB3
  Gene Name: LIM domain binding 3
  Uniprot ID: O75112
  ENSP ID: ENSP00000263066
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 46728 - protein, 727 aa, Homo sapiens
  Payload ID: 9454
  Gene Symbol: LDB3
  Gene Name: LIM domain binding 3
  Uniprot ID: O75112
  ENSP ID: ENSP00000355296
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGSLPIKDLAVDSASPVYQAVIKSQNKPEDEADEWARRSSNLQSRSFRILAQMTGTEFMQDPDEEALRRSSTPIEHAPVCTSQATTPLLPASAQPPAAASPSAASPPLATAAAHTAIASASTTAPASSPADSPRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 46729 - protein, 398 aa, Homo sapiens
  Payload ID: 9454
  Gene Symbol: LDB3
  Gene Name: LIM domain binding 3
  Uniprot ID: O75112
  ENSP ID: ENSP00000361126
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 46730 - protein, 283 aa, Homo sapiens
  Payload ID: 9454
  Gene Symbol: LDB3
  Gene Name: LIM domain binding 3
  Uniprot ID: O75112
  ENSP ID: ENSP00000361136
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 46731 - protein, 732 aa, Homo sapiens
  Payload ID: 9454
  Gene Symbol: LDB3
  Gene Name: LIM domain binding 3
  Uniprot ID: O75112
  ENSP ID: ENSP00000401437
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 46732 - protein, 231 aa, Homo sapiens
  Payload ID: 9454
  Gene Symbol: LDB3
  Gene Name: LIM domain binding 3
  ENSP ID: ENSP00000438866
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGW

SEQ ID NO: 46733 - protein, 330 aa, Homo sapiens
  Payload ID: 9454
  Gene Symbol: LDB3
  Gene Name: LIM domain binding 3
  Uniprot ID: O75112
  ENSP ID: ENSP00000485389
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 46734 - protein, 732 aa, Homo sapiens; identical to SEQ ID NO: 46731
  Payload ID: 9454
  Gene Symbol: LDB3
  Gene Name: LIM domain binding 3
  Uniprot ID: O75112
  ENSP ID: ENSP00000485500

SEQ ID NO: 46735 - protein, 81 aa, Homo sapiens
  Payload ID: 9454
  Gene Symbol: LDB3
  Gene Name: LIM domain binding 3
  ENSP ID: ENSP00000485538
VMHALRQTWHTTCFVCAACKKPFGNSLFHMEDGEPYCEKDYINLFSTKCHGCDFPVEAGDKFIEALGHTWHDTCFICAVCL

SEQ ID NO: 46736 - protein, 127 aa, Homo sapiens
  Payload ID: 9455
  Gene Symbol: LIMD2
  Gene Name: LIM domain containing 2
  Uniprot ID: Q9BT23
  ENSP ID: ENSP00000259006
MFQAAGAAQATPSHDAKGGGSSTVQRSKSFSLRAQVKETCAACQKTVYPMERLVADKLIFHNSCFCCKHCHTKLSLGSYAALHGEFYCKPHFQQLFKSKGNYDEGFGRKQHKELWAHKEVDPGTKTA

SEQ ID NO: 46737 - protein, 87 aa, Homo sapiens
  Payload ID: 9455
  Gene Symbol: LIMD2
  Gene Name: LIM domain containing 2
  ENSP ID: ENSP00000462125
MFQAAGAAQATPSHDAKGGGSSTVQRSKHCHTKLSLGSYAALHGEFYCKPHFQQLFKSKGNYDEGFGRKQHKELWAHKEVDPGTKTA

SEQ ID NO: 46738 - protein, 127 aa, Homo sapiens; identical to SEQ ID NO: 46736
  Payload ID: 9455
  Gene Symbol: LIMD2
  Gene Name: LIM domain containing 2
  Uniprot ID: Q9BT23
  ENSP ID: ENSP00000462707

SEQ ID NO: 46739 - protein, 78 aa, Homo sapiens
  Payload ID: 9455
  Gene Symbol: LIMD2
  Gene Name: LIM domain containing 2
  ENSP ID: ENSP00000463089
MERLVADKLIFHNSCFCCKHCHTKLSLGSYAALHGEFYCKPHFQQLFKSKGNYDEGFGRKQHKELWAHKEVDPGTKTA

SEQ ID NO: 46740 - protein, 78 aa, Homo sapiens; identical to SEQ ID NO: 46739
  Payload ID: 9455
  Gene Symbol: LIMD2
  Gene Name: LIM domain containing 2
  ENSP ID: ENSP00000463409

SEQ ID NO: 46741 - protein, 78 aa, Homo sapiens; identical to SEQ ID NO: 46739
  Payload ID: 9455
  Gene Symbol: LIMD2
  Gene Name: LIM domain containing 2
  ENSP ID: ENSP00000463656

SEQ ID NO: 46742 - protein, 109 aa, Homo sapiens
  Payload ID: 9455
  Gene Symbol: LIMD2
  Gene Name: LIM domain containing 2
  ENSP ID: ENSP00000463805
MFQAAGAAQATPSHDAKGGGSSTVQRSKSFSLRAQVKETCAACQKTVYPMERLVADKLIFHNSCFCCKHCHTKLSLGSYAALHGEFYCKPHFQQLFKSKGNYDEGFGRK

SEQ ID NO: 46743 - protein, 127 aa, Homo sapiens; identical to SEQ ID NO: 46736
  Payload ID: 9455
  Gene Symbol: LIMD2
  Gene Name: LIM domain containing 2
  Uniprot ID: Q9BT23
  ENSP ID: ENSP00000464003

SEQ ID NO: 46744 - protein, 93 aa, Homo sapiens
  Payload ID: 9456
  Gene Symbol: LPP
  Gene Name: LIM domain containing preferred translocation partner in lipoma
  ENSP ID: ENSP00000392667
MSHPSWLPPKSTGEPLGHVPARMETTHSFGNPSISVSTQQPPKKFAPVVAPKPKYNPYKQPGGEGDFLPPPPPPLDDSSALPSISGNFPPPPP

SEQ ID NO: 46745 - protein, 252 aa, Homo sapiens
  Payload ID: 9456
  Gene Symbol: LPP
  Gene Name: LIM domain containing preferred translocation partner in lipoma
  ENSP ID: ENSP00000393008
MVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFEC

SEQ ID NO: 46746 - protein, 428 aa, Homo sapiens
  Payload ID: 9456
  Gene Symbol: LPP
  Gene Name: LIM domain containing preferred translocation partner in lipoma
  ENSP ID: ENSP00000393602
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGEWGLELTSEVTILL

SEQ ID NO: 46747 - protein, 65 aa, Homo sapiens
  Payload ID: 9456
  Gene Symbol: LPP
  Gene Name: LIM domain containing preferred translocation partner in lipoma
  ENSP ID: ENSP00000394257
MSHPSWLPPKSTGEPLGHVPARMETTHSFGNPSISVSTQQPPKKFAPVVAPKPKYNPYKQPGGEG

SEQ ID NO: 46748 - protein, 66 aa, Homo sapiens
  Payload ID: 9456
  Gene Symbol: LPP
  Gene Name: LIM domain containing preferred translocation partner in lipoma
  ENSP ID: ENSP00000397017
MSHPSWLPPKSTGEPLGHVPARMETTHSFGNPSISVSTQQPPKKFAPVVAPKPKYNPYKQPGGEGD

SEQ ID NO: 46749 - protein, 52 aa, Homo sapiens
  Payload ID: 9456
  Gene Symbol: LPP
  Gene Name: LIM domain containing preferred translocation partner in lipoma
  ENSP ID: ENSP00000397166
MSHPSWLPPKSTGEPLGHVPARMETTHSFGNPSISVSTQQPPKKFAPVVAPK

SEQ ID NO: 46750 - protein, 57 aa, Homo sapiens
  Payload ID: 9456
  Gene Symbol: LPP
  Gene Name: LIM domain containing preferred translocation partner in lipoma
  ENSP ID: ENSP00000403825
MSHPSWLPPKSTGEPLGHVPARMETTHSFGNPSISVSTQQPPKKFAPVVAPKPKYNP

SEQ ID NO: 46751 - protein, 46 aa, Homo sapiens
  Payload ID: 9456
  Gene Symbol: LPP
  Gene Name: LIM domain containing preferred translocation partner in lipoma
  ENSP ID: ENSP00000404679
MSHPSWLPPKSTGEPLGHVPARMETTHSFGNPSISVSTQQPPKKFA

SEQ ID NO: 46752 - protein, 111 aa, Homo sapiens
  Payload ID: 9456
  Gene Symbol: LPP
  Gene Name: LIM domain containing preferred translocation partner in lipoma
  ENSP ID: ENSP00000405138
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLE

SEQ ID NO: 46753 - protein, 151 aa, Homo sapiens
  Payload ID: 9456
  Gene Symbol: LPP
  Gene Name: LIM domain containing preferred translocation partner in lipoma
  ENSP ID: ENSP00000410340
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTAS

SEQ ID NO: 46754 - protein, 612 aa, Homo sapiens
  Payload ID: 9456
  Gene Symbol: LPP
  Gene Name: LIM domain containing preferred translocation partner in lipoma
  Uniprot ID: Q93052
  ENSP ID: ENSP00000478901
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGRCARCGENVVGEGTGCTAMDQVFHVDCFTCIICNNKLRGQPFYAVEKKAYCEPCYINTLEQCNVCSKPIMERILRATGKAYHPHCFTCVMCHRSLDGIPFTVDAGGLIHCIEDFHKKFAPRCSVCKEPIMPAPGQEETVRIVALDRDFHVHCYRCEDCGGLLSEGDNQGCYPLDGHILCKTCNSARIRVLTAKASTDL

SEQ ID NO: 46755 - protein, 590 aa, Homo sapiens
  Payload ID: 9456
  Gene Symbol: LPP
  Gene Name: LIM domain containing preferred translocation partner in lipoma
  ENSP ID: ENSP00000482617
METTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGRCARCGENVVGEGTGCTAMDQVFHVDCFTCIICNNKLRGQPFYAVEKKAYCEPCYINTLEQCNVCSKPIMERILRATGKAYHPHCFTCVMCHRSLDGIPFTVDAGGLIHCIEDFHKKFAPRCSVCKEPIMPAPGQEETVRIVALDRDFHVHCYRCEDCGGLLSEGDNQGCYPLDGHILCKTCNSARIRVLTAKASTDL

SEQ ID NO: 46756 - protein, 647 aa, Homo sapiens
  Payload ID: 9457
  Gene Symbol: LIMK1
  Gene Name: LIM domain kinase 1
  Uniprot ID: P53667
  ENSP ID: ENSP00000336740
MRLTLLCCTWREERMGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVTHRETGEVMVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 46757 - protein, 677 aa, Homo sapiens
  Payload ID: 9457
  Gene Symbol: LIMK1
  Gene Name: LIM domain kinase 1
  ENSP ID: ENSP00000409717
MSSILELSTSRQGVPPSVLDWTTQFLWTLDSAQTRAPSRTLGRAAPAPGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVTHRETGEVMVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 46758 - protein, 305 aa, Homo sapiens
  Payload ID: 9457
  Gene Symbol: LIMK1
  Gene Name: LIM domain kinase 1
  Uniprot ID: P53667
  ENSP ID: ENSP00000414606
MRLTLLCCTWREERMGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVFARTWVALSPSA

SEQ ID NO: 46759 - protein, 613 aa, Homo sapiens
  Payload ID: 9457
  Gene Symbol: LIMK1
  Gene Name: LIM domain kinase 1
  Uniprot ID: P53667
  ENSP ID: ENSP00000444452
MLLASAPRRRRFLQRAKCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVTHRETGEVMVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 46760 - protein, 617 aa, Homo sapiens
  Payload ID: 9458
  Gene Symbol: LIMK2
  Gene Name: LIM domain kinase 2
  Uniprot ID: P53671
  ENSP ID: ENSP00000330470
MGSYLSVPAYFTSRDLFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRPAFSKLEDSFEALSLYLGELGIPLPAELEELDHTVSMQYGLTRDSPP

SEQ ID NO: 46761 - protein, 638 aa, Homo sapiens
  Payload ID: 9458
  Gene Symbol: LIMK2
  Gene Name: LIM domain kinase 2
  Uniprot ID: P53671
  ENSP ID: ENSP00000332687
MSALAGEDVWRCPGCGDHIAPSQIWYRTVNETWHGSCFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRPAFSKLEDSFEALSLYLGELGIPLPAELEELDHTVSMQYGLTRDSPP

SEQ ID NO: 46762 - protein, 686 aa, Homo sapiens
  Payload ID: 9458
  Gene Symbol: LIMK2
  Gene Name: LIM domain kinase 2
  Uniprot ID: P53671
  ENSP ID: ENSP00000339916
MGSYLSVPAYFTSRDLFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRAPPGAAGEGPGCADDEGPVRRQGKVTIKYDPKELRKHLNLEEWILEQLTRLYDCQEEEISELEIDVDELLDMESDDAWASRVKELLVDCYKPTEAFISGLLDKIRAMQKLSTPQKK

SEQ ID NO: 46763 - protein, 629 aa, Homo sapiens
  Payload ID: 9458
  Gene Symbol: LIMK2
  Gene Name: LIM domain kinase 2
  ENSP ID: ENSP00000384602
MTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRAPPGAAGEGPGCADDEGPVRRQGKVTIKYDPKELRKHLNLEEWILEQLTRLYDCQEEEISELEIDVDELLDMESDDAWASRVKELLVDCYKPTEAFISGLLDKIRAMQKLSTPQKK

SEQ ID NO: 46764 - protein, 82 aa, Homo sapiens
  Payload ID: 9458
  Gene Symbol: LIMK2
  Gene Name: LIM domain kinase 2
  ENSP ID: ENSP00000388422
MGSYLSVPAYFTSRDLFRCSECQDSLTNWYYEKDGKLYCPKDYWGKFGEFCHGCSLLMTGPFMVSESLHICPSWSSESIDSA

SEQ ID NO: 46765 - protein, 156 aa, Homo sapiens
  Payload ID: 9459
  Gene Symbol: LMO1
  Gene Name: LIM domain only 1 (rhombotin 1)
  Uniprot ID: P25800
  ENSP ID: ENSP00000338207
MMVLDKEDGVPMLSVQPKGKQKGCAGCNRKIKDRYLLKALDKYWHEDCLKCACCDCRLGEVGSTLYTKANLILCRRDYLRLFGTTGNCAACSKLIPAFEMVMRARDNVYHLDCFACQLCNQRFCVGDKFFLKNNMILCQMDYEEGQLNGTFESQVQ

SEQ ID NO: 46766 - protein, 155 aa, Homo sapiens
  Payload ID: 9459
  Gene Symbol: LMO1
  Gene Name: LIM domain only 1 (rhombotin 1)
  Uniprot ID: P25800
  ENSP ID: ENSP00000404538
MVLDQEDGVPMLSVQPKGKQKGCAGCNRKIKDRYLLKALDKYWHEDCLKCACCDCRLGEVGSTLYTKANLILCRRDYLRLFGTTGNCAACSKLIPAFEMVMRARDNVYHLDCFACQLCNQRFCVGDKFFLKNNMILCQMDYEEGQLNGTFESQVQ

SEQ ID NO: 46767 - protein, 145 aa, Homo sapiens
  Payload ID: 9459
  Gene Symbol: LMO1
  Gene Name: LIM domain only 1 (rhombotin 1)
  ENSP ID: ENSP00000435456
MLSVQPKGKQKGCAGCNRKIKDRYLLKALDKYWHEDCLKCACCDCRLGEVGSTLYTKANLILCRRDYLRLFGTTGNCAACSKLIPAFEMVMRARDNVYHLDCFACQLCNQRFCVGDKFFLKNNMILCQMDYEEGQLNGTFESQVQ

SEQ ID NO: 46768 - protein, 227 aa, Homo sapiens
  Payload ID: 9460
  Gene Symbol: LMO2
  Gene Name: LIM domain only 2 (rhombotin-like 1)
  Uniprot ID: P25791
  ENSP ID: ENSP00000257818
MEGSAVTVLERGGASSPAERRSKRRRRSGGDGGGGGGARAPEGVRAPAAGQPRATKGAPPPPGTPPPSPMSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 46769 - protein, 158 aa, Homo sapiens
  Payload ID: 9460
  Gene Symbol: LMO2
  Gene Name: LIM domain only 2 (rhombotin-like 1)
  Uniprot ID: P25791
  ENSP ID: ENSP00000379175
MSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 46770 - protein, 55 aa, Homo sapiens
  Payload ID: 9460
  Gene Symbol: LMO2
  Gene Name: LIM domain only 2 (rhombotin-like 1)
  Uniprot ID: P25791
  ENSP ID: ENSP00000401967
MSSAIERKSLDPSESLKGSQVRCPVWPKTISDPRCWSHSGEAVPDAWPSLQGTSG

SEQ ID NO: 46771 - protein, 156 aa, Homo sapiens
  Payload ID: 9461
  Gene Symbol: LMO3
  Gene Name: LIM domain only 3 (rhombotin-like 2)
  Uniprot ID: Q8TAP4
  ENSP ID: ENSP00000261169
MQKKEKSFGIQMLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKFFLKNNMILCQTDYEEGLMKEGYAPQVR

SEQ ID NO: 46772 - protein, 145 aa, Homo sapiens
  Payload ID: 9461
  Gene Symbol: LMO3
  Gene Name: LIM domain only 3 (rhombotin-like 2)
  Uniprot ID: Q8TAP4
  ENSP ID: ENSP00000312856
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKFFLKNNMILCQTDYEEGLMKEGYAPQVR

SEQ ID NO: 46773 - protein, 145 aa, Homo sapiens; identical to SEQ ID NO: 46772
  Payload ID: 9461
  Gene Symbol: LMO3
  Gene Name: LIM domain only 3 (rhombotin-like 2)
  Uniprot ID: Q8TAP4
  ENSP ID: ENSP00000346689

SEQ ID NO: 46774 - protein, 69 aa, Homo sapiens
  Payload ID: 9461
  Gene Symbol: LMO3
  Gene Name: LIM domain only 3 (rhombotin-like 2)
  ENSP ID: ENSP00000379508
MLSVQPDTKPKGCAGCNRKIKDRYLLKALDKYWHEDCLKCACCDCRLGEVGSTLYTKANLILCRRDYLR

SEQ ID NO: 46775 - protein, 60 aa, Homo sapiens
  Payload ID: 9461
  Gene Symbol: LMO3
  Gene Name: LIM domain only 3 (rhombotin-like 2)
  ENSP ID: ENSP00000404386
MLSVQPDTKPKGCAGCNRKIKDRYLLKALDKYWHEDCLKCACCDCRLGEALWCNGKLRCL

SEQ ID NO: 46776 - protein, 70 aa, Homo sapiens
  Payload ID: 9461
  Gene Symbol: LMO3
  Gene Name: LIM domain only 3 (rhombotin-like 2)
  ENSP ID: ENSP00000404656
MLSVQPDTKPKGCAGCNRKIKDRYLLKALDKYWHEDCLKCACCDCRLGEVGSTLYTKANLILCRRDYLSI

SEQ ID NO: 46777 - protein, 145 aa, Homo sapiens; identical to SEQ ID NO: 46772
  Payload ID: 9461
  Gene Symbol: LMO3
  Gene Name: LIM domain only 3 (rhombotin-like 2)
  Uniprot ID: Q8TAP4
  ENSP ID: ENSP00000412479

SEQ ID NO: 46778 - protein, 145 aa, Homo sapiens; identical to SEQ ID NO: 46772
  Payload ID: 9461
  Gene Symbol: LMO3
  Gene Name: LIM domain only 3 (rhombotin-like 2)
  Uniprot ID: Q8TAP4
  ENSP ID: ENSP00000413703

SEQ ID NO: 46779 - protein, 92 aa, Homo sapiens
  Payload ID: 9461
  Gene Symbol: LMO3
  Gene Name: LIM domain only 3 (rhombotin-like 2)
  ENSP ID: ENSP00000437890
MLSVQPDTKPKGCAGCNRKIKDRYLLKALDKYWHEDCLKCACCDCRLGEVGSTLYTKANLILCRRDYLSISSGFMLPFQIRSLYSPGNVKVF

SEQ ID NO: 46780 - protein, 60 aa, Homo sapiens; identical to SEQ ID NO: 46775
  Payload ID: 9461
  Gene Symbol: LMO3
  Gene Name: LIM domain only 3 (rhombotin-like 2)
  ENSP ID: ENSP00000438187

SEQ ID NO: 46781 - protein, 145 aa, Homo sapiens; identical to SEQ ID NO: 46772
  Payload ID: 9461
  Gene Symbol: LMO3
  Gene Name: LIM domain only 3 (rhombotin-like 2)
  Uniprot ID: Q8TAP4
  ENSP ID: ENSP00000439275

SEQ ID NO: 46782 - protein, 69 aa, Homo sapiens; identical to SEQ ID NO: 46774
  Payload ID: 9461
  Gene Symbol: LMO3
  Gene Name: LIM domain only 3 (rhombotin-like 2)
  ENSP ID: ENSP00000439900

SEQ ID NO: 46783 - protein, 84 aa, Homo sapiens
  Payload ID: 9461
  Gene Symbol: LMO3
  Gene Name: LIM domain only 3 (rhombotin-like 2)
  ENSP ID: ENSP00000439989
MLSVQPDTKPKGCAGCNRKIKDRYLLKALDKYWHEDCLKCACCDCRLGEVGSTLYTKANLILCRRDYLRLFGVTGNCAACSKLI

SEQ ID NO: 46784 - protein, 145 aa, Homo sapiens; identical to SEQ ID NO: 46772
  Payload ID: 9461
  Gene Symbol: LMO3
  Gene Name: LIM domain only 3 (rhombotin-like 2)
  Uniprot ID: Q8TAP4
  ENSP ID: ENSP00000440099

SEQ ID NO: 46785 - protein, 60 aa, Homo sapiens; identical to SEQ ID NO: 46775
  Payload ID: 9461
  Gene Symbol: LMO3
  Gene Name: LIM domain only 3 (rhombotin-like 2)
  ENSP ID: ENSP00000440885

SEQ ID NO: 46786 - protein, 60 aa, Homo sapiens; identical to SEQ ID NO: 46775
  Payload ID: 9461
  Gene Symbol: LMO3
  Gene Name: LIM domain only 3 (rhombotin-like 2)
  ENSP ID: ENSP00000440948

SEQ ID NO: 46787 - protein, 110 aa, Homo sapiens
  Payload ID: 9461
  Gene Symbol: LMO3
  Gene Name: LIM domain only 3 (rhombotin-like 2)
  ENSP ID: ENSP00000441360
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQ

SEQ ID NO: 46788 - protein, 118 aa, Homo sapiens
  Payload ID: 9461
  Gene Symbol: LMO3
  Gene Name: LIM domain only 3 (rhombotin-like 2)
  ENSP ID: ENSP00000442713
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKF

SEQ ID NO: 46789 - protein, 167 aa, Homo sapiens
  Payload ID: 9461
  Gene Symbol: LMO3
  Gene Name: LIM domain only 3 (rhombotin-like 2)
  Uniprot ID: Q8TAP4
  ENSP ID: ENSP00000442786
MLSVQPDTKPKGCAGCNRKIKDRYLLKALDKYWHEDCLKCACCDCRLGEHLKRCGSIYIHAAHTEIGICVTLEWPLPFVIIDFSQQITIAWLFGVTGNCAACSKLIPAFEMVMRAKDNVYHLDCFACQLCNQRFCVGDKFFLKNNMILCQTDYEEGLMKEGYAPQVR

SEQ ID NO: 46790 - protein, 118 aa, Homo sapiens; identical to SEQ ID NO: 46788
  Payload ID: 9461
  Gene Symbol: LMO3
  Gene Name: LIM domain only 3 (rhombotin-like 2)
  ENSP ID: ENSP00000443807

SEQ ID NO: 46791 - protein, 88 aa, Homo sapiens
  Payload ID: 9461
  Gene Symbol: LMO3
  Gene Name: LIM domain only 3 (rhombotin-like 2)
  ENSP ID: ENSP00000444269
MLSVQPDTKPKGCAGCNRKIKDRYLLKALDKYWHEDCLKCACCDCRLGEVGSTLYTKANLILCRRDYLRLFGVTGNCAACSKLIPAFE

SEQ ID NO: 46792 - protein, 145 aa, Homo sapiens; identical to SEQ ID NO: 46772
  Payload ID: 9461
  Gene Symbol: LMO3
  Gene Name: LIM domain only 3 (rhombotin-like 2)
  Uniprot ID: Q8TAP4
  ENSP ID: ENSP00000444393

SEQ ID NO: 46793 - protein, 118 aa, Homo sapiens; identical to SEQ ID NO: 46788
  Payload ID: 9461
  Gene Symbol: LMO3
  Gene Name: LIM domain only 3 (rhombotin-like 2)
  ENSP ID: ENSP00000445193

SEQ ID NO: 46794 - protein, 97 aa, Homo sapiens
  Payload ID: 9461
  Gene Symbol: LMO3
  Gene Name: LIM domain only 3 (rhombotin-like 2)
  ENSP ID: ENSP00000445504
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNV

SEQ ID NO: 46795 - protein, 145 aa, Homo sapiens; identical to SEQ ID NO: 46772
  Payload ID: 9461
  Gene Symbol: LMO3
  Gene Name: LIM domain only 3 (rhombotin-like 2)
  Uniprot ID: Q8TAP4
  ENSP ID: ENSP00000445751

SEQ ID NO: 46796 - protein, 58 aa, Homo sapiens
  Payload ID: 9461
  Gene Symbol: LMO3
  Gene Name: LIM domain only 3 (rhombotin-like 2)
  ENSP ID: ENSP00000446095
MLSVQPDTKPKGCAGCNRKIKDRYLLKALDKYWHEDCLKCACCDCRLGEVGSTLYTKA

SEQ ID NO: 46797 - protein, 145 aa, Homo sapiens; identical to SEQ ID NO: 46772
  Payload ID: 9461
  Gene Symbol: LMO3
  Gene Name: LIM domain only 3 (rhombotin-like 2)
  Uniprot ID: Q8TAP4
  ENSP ID: ENSP00000446115

SEQ ID NO: 46798 - protein, 163 aa, Homo sapiens
  Payload ID: 9461
  Gene Symbol: LMO3
  Gene Name: LIM domain only 3 (rhombotin-like 2)
  Uniprot ID: Q8TAP4
  ENSP ID: ENSP00000446463
MLMEGGRAAAARNVSSIQMLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKFFLKNNMILCQTDYEEGLMKEGYAPQVR

SEQ ID NO: 46799 - protein, 125 aa, Homo sapiens [sequence omitted]

SEQ ID NO: 46800 - protein, 165 aa, Homo sapiens
  Payload ID: 9462
  Gene Symbol: LMO4
  Gene Name: LIM domain only 4
  Uniprot ID: P61968
  ENSP ID: ENSP00000359573
MVNPGSSSQPPPVTAGSLSWKRCAGCGGKIADRFLLYAMDSYWHSRCLKCSCCQAQLGDIGTSCYTKSGMILCRNDYIRLFGNSGACSACGQSIPASELVMRAQGNVYHLKCFTCSTCRNRLVPGDRFHYINGSLFCEHDRPTALINGHLNSLQSNPLLPDQKVC

SEQ ID NO: 46801 - protein, 165 aa, Homo sapiens; identical to SEQ ID NO: 46800
  Payload ID: 9462
  Gene Symbol: LMO4
  Gene Name: LIM domain only 4
  Uniprot ID: P61968
  ENSP ID: ENSP00000359575

SEQ ID NO: 46802 - protein, 676 aa, Homo sapiens
  Payload ID: 9463
  Gene Symbol: LIMD1
  Gene Name: LIM domains containing 1
  Uniprot ID: Q9UGP4
  ENSP ID: ENSP00000273317
MDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEGSDETIRVVSMDRDYHVECYHCEDCGLELNDEDGHRCYPLEDHLFCHSCHVKRLEKRPSSTALHQHHF

SEQ ID NO: 46803 - protein, 620 aa, Homo sapiens
  Payload ID: 9463
  Gene Symbol: LIMD1
  Gene Name: LIM domains containing 1
  ENSP ID: ENSP00000394537
MDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEVRCPSRHAPRGF

SEQ ID NO: 46804 - protein, 406 aa, Homo sapiens
  Payload ID: 9464
  Gene Symbol: LHX1
  Gene Name: LIM homeobox 1
  Uniprot ID: P48742
  ENSP ID: ENSP00000477829
MVHCAGCKRPILDRFLLNVLDRAWHVKCVQCCECKCNLTEKCFSREGKLYCKNDFFRCFGTKCAGCAQGISPSDLVRRARSKVFHLNCFTCMMCNKQLSTGEELYIIDENKFVCKEDYLSNSSVAKENSLHSATTGSDPSLSPDSQDPSQDDAKDSESANVSDKEAGSNENDDQNLGAKRRGPRTTIKAKQLETLKAAFAATPKPTRHIREQLAQETGLNMRVIQVWFQNRRSKERRMKQLSALGARRHAFFRSPRRMRPLVDRLEPGELIPNGPFSFYGDYQSEYYGPGGNYDFFPQGPPSSQAQTPVDLPFVPSSGPSGTPLGGLEHPLPGHHPSSEAQRFTDILAHPPGDSPSPEPSLPGPLHSMSAEVFGPSPPFSSLSVNGGASYGNHLSHPPEMNEAAVW

SEQ ID NO: 46805 - protein, 141 aa, Homo sapiens
  Payload ID: 9464
  Gene Symbol: LHX1
  Gene Name: LIM homeobox 1
  ENSP ID: ENSP00000481496
  MOD_RES (1)..(1): Any amino acid
XRPLVDRLEPGELIPNGPFSFYGASRTILLLGRPDGKGGHEIGSKSASRWDWDPRTGCRRAELGLPKGNADLSPTPTWTRIRRQTPRACAPGRRAAKRRPGQPRVRTAVGDARSRGEGGREHSRVKEVKRPRALPGQPGGF

SEQ ID NO: 46806 - protein, 406 aa, Homo sapiens; identical to SEQ ID NO: 46804
  Payload ID: 9464
  Gene Symbol: LHX1
  Gene Name: LIM homeobox 1
  Uniprot ID: P48742
  ENSP ID: ENSP00000484449

SEQ ID NO: 46807 - protein, 141 aa, Homo sapiens; identical to SEQ ID NO: 46805
  Payload ID: 9464
  Gene Symbol: LHX1
  Gene Name: LIM homeobox 1
  ENSP ID: ENSP00000488248
  MOD_RES (1)..(1): Any amino acid

SEQ ID NO: 46808 - protein, 406 aa, Homo sapiens
  Payload ID: 9465
  Gene Symbol: LHX2
  Gene Name: LIM homeobox 2
  Uniprot ID: P50458
  ENSP ID: ENSP00000362717
MLFHSLSGPEVHGVIDEMDRRAKSEAPAISSAIDRGDTETTMPSISSDRAALCAGCGGKISDRYYLLAVDKQWHMRCLKCCECKLNLESELTCFSKDGSIYCKEDYYRRFSVQRCARCHLGISASEMVMRARDLVYHLNCFTCTTCNKMLTTGDHFGMKDSLVYCRLHFEALLQGEYPAHFNHADVAAAAAAAAAAKSAGLGAAGANPLGLPYYNGVGTVQKGRPRKRKSPGPGADLAAYNAALSCNENDAEHLDRDQPYPSSQKTKRMRTSFKHHQLRTMKSYFAINHNPDAKDLKQLAQKTGLTKRVLQVWFQNARAKFRRNLLRQENTGVDKSTDAALQTGTPSGPASELSNASLSPSSTPTTLTDLTSPTLPTVTSVLTSVPGNLEGHEPHSPSQTTLTNLF

SEQ ID NO: 46809 - protein, 412 aa, Homo sapiens
  Payload ID: 9465
  Gene Symbol: LHX2
  Gene Name: LIM homeobox 2
  ENSP ID: ENSP00000394978
  MOD_RES (1)..(1): Any amino acid
XHSLSGPEVHGVIDEMDRRAKSEAPAISSAIDRGDTETTMPSISSDRAALCAGCGGKISDRYYLLAVDKQWHMRCLKCCECKLNLESELTCFSKDGSIYCKEDYYSPSLHGPYRRFSVQRCARCHLGISASEMVMRARDLVYHLNCFTCTTCNKMLTTGDHFGMKDSLVYCRLHFEALLQGEYPAHFNHADVAAAAAAAAAAKSAGLGAAGANPLGLPYYNGVGTVQKGRPRKRKSPGPGADLAAYNAALSCNENDAEHLDRDQPYPSSQKTKRMRTSFKHHQLRTMKSYFAINHNPDAKDLKQLAQKTGLTKRVLQVWFQNARAKFRRNLLRQENTGVDKSTDAALQTGTPSGPASELSNASLSPSSTPTTLTDLTSPTLPTVTSVLTSVPGNLEGHEPHSPSQTTLTNLF

SEQ ID NO: 46810 - protein, 146 aa, Homo sapiens
  Payload ID: 9465
  Gene Symbol: LHX2
  Gene Name: LIM homeobox 2
  ENSP ID: ENSP00000453448
MPSISSDRAALCAGCGGKISDRYYLLAVDKQWHMRCLKCCECKLNLESELTCFSKDGSIYCKEDYYRRFSVQRCARCHLGISASEMVMRARDLVYHLNCFTCTTCNKMLTTGDHFGMKDSLVYCRLHFEALLQGEYPAHFNHADVA

SEQ ID NO: 46811 - protein, 115 aa, Homo sapiens
  Payload ID: 9465
  Gene Symbol: LHX2
  Gene Name: LIM homeobox 2
  ENSP ID: ENSP00000476200
  MOD_RES (1)..(1): Any amino acid
XLGAAGANPLGLPYYNGVGTVQKGRPRKRKSPGPGADLAAYNAALSCNENDAEHLDRDQPYPSSQKTKRMRTSFKHHQLRTMKSYFAINHNPDAKDLKQLAQKTGLTKRVLQASL

SEQ ID NO: 46812 - protein, 402 aa, Homo sapiens
  Payload ID: 9466
  Gene Symbol: LHX3
  Gene Name: LIM homeobox 3
  Uniprot ID: Q9UBR4
  ENSP ID: ENSP00000360811
MEARGELGPARESAGGDLLLALLARRADLRREIPLCAGCDQHILDRFILKALDRHWHSKCLKCSDCHTPLAERCFSRGESVYCKDDFFKRFGTKCAACQLGIPPTQVVRRAQDFVYHLHCFACVVCKRQLATGDEFYLMEDSRLVCKADYETAKQREAEATAKRPRTTITAKQLETLKSAYNTSPKPARHVREQLSSETGLDMRVVQVWFQNRRAKEKRLKKDAGRQRWGQYFRNMKRSRGGSKSDKDSVQEGQDSDAEVSFPDEPSLAEMGPANGLYGSLGEPTQALGRPSGALGNFSLEHGGLAGPEQYRELRPGSPYGVPPSPAAPQSLPGPQPLLSSLVYPDTSLGLVPSGAPGGPPPMRVLAGNGPSSDLSTGSSGGYPDFPASPASWLDEVDHAQF

SEQ ID NO: 46813 - protein, 397 aa, Homo sapiens
  Payload ID: 9466
  Gene Symbol: LHX3
  Gene Name: LIM homeobox 3
  Uniprot ID: Q9UBR4
  ENSP ID: ENSP00000360813
MLLETGLERDRARPGAAAVCTLGGTREIPLCAGCDQHILDRFILKALDRHWHSKCLKCSDCHTPLAERCFSRGESVYCKDDFFKRFGTKCAACQLGIPPTQVVRRAQDFVYHLHCFACVVCKRQLATGDEFYLMEDSRLVCKADYETAKQREAEATAKRPRTTITAKQLETLKSAYNTSPKPARHVREQLSSETGLDMRVVQVWFQNRRAKEKRLKKDAGRQRWGQYFRNMKRSRGGSKSDKDSVQEGQDSDAEVSFPDEPSLAEMGPANGLYGSLGEPTQALGRPSGALGNFSLEHGGLAGPEQYRELRPGSPYGVPPSPAAPQSLPGPQPLLSSLVYPDTSLGLVPSGAPGGPPPMRVLAGNGPSSDLSTGSSGGYPDFPASPASWLDEVDHAQF

SEQ ID NO: 46814 - protein, 386 aa, Homo sapiens
  Payload ID: 9466
  Gene Symbol: LHX3
  Gene Name: LIM homeobox 3
  ENSP ID: ENSP00000483080
MTLNMKETRWGAPAPEIPLCAGCDQHILDRFILKALDRHWHSKCLKCSDCHTPLAERCFSRGESVYCKDDFFKRFGTKCAACQLGIPPTQVVRRAQDFVYHLHCFACVVCKRQLATGDEFYLMEDSRLVCKADYETAKQREAEATAKRPRTTITAKQLETLKSAYNTSPKPARHVREQLSSETGLDMRVVQVWFQNRRAKEKRLKKDAGRQRWGQYFRNMKRSRGGSKSDKDSVQEGQDSDAEVSFPDEPSLAEMGPANGLYGSLGEPTQALGRPSGALGNFSLEHGGLAGPEQYRELRPGSPYGVPPSPAAPQSLPGPQPLLSSLVYPDTSLGLVPSGAPGGPPPMRVLAGNGPSSDLSTGSSGGYPDFPASPASWLDEVDHAQF

SEQ ID NO: 46815 - protein, 390 aa, Homo sapiens
  Payload ID: 9467
  Gene Symbol: LHX4
  Gene Name: LIM homeobox 4
  Uniprot ID: Q969G2
  ENSP ID: ENSP00000263726
MMQSATVPAEGAVKGLPEMLGVPMQQIPQCAGCNQHILDKFILKVLDRHWHSSCLKCADCQMQLADRCFSRAGSVYCKEDFFKRFGTKCTACQQGIPPTQVVRKAQDFVYHLHCFACIICNRQLATGDEFYLMEDGRLVCKEDYETAKQNDDSEAGAKRPRTTITAKQLETLKNAYKNSPKPARHVREQLSSETGLDMRVVQVWFQNRRAKEKRLKKDAGRHRWGQFYKSVKRSRGSSKQEKESSAEDCGVSDSELSFREDQILSELGHTNRIYGNVGDVTGGQLMNGSFSMDGTGQSYQDLRDGSPYGIPQSPSSISSLPSHAPLLNGLDYTVDSNLGIIAHAGQGVSQTLRAMAGGPTSDISTGSSVGYPDFPTSPGSWLDEMDHPPF

SEQ ID NO: 46816 - protein, 151 aa, Homo sapiens
  Payload ID: 9467
  Gene Symbol: LHX4
  Gene Name: LIM homeobox 4
  ENSP ID: ENSP00000452783
  MOD_RES (1)..(1): Any amino acid
XDSPVRWLQPAHPGQVHPEGPGQTLAQLLPQVCRLPDAAGGQVLLQGWERLLQGGLLQVSQNGASAQNARPASRVSPQPRWSARPRTLSTTCTALLASSATGSWPRGTNSTSWRTGGWCARKTTRQPSRTMTQRLELSGPGPPSQPSSWRH

SEQ ID NO: 46817 - protein, 402 aa, Homo sapiens
  Payload ID: 9468
  Gene Symbol: LHX5
  Gene Name: LIM homeobox 5
  Uniprot ID: Q9H2C1
  ENSP ID: ENSP00000261731
MMVHCAGCERPILDRFLLNVLDRAWHIKCVQCCECKTNLSEKCFSREGKLYCKNDFFRRFGTKCAGCAQGISPSDLVRKARSKVFHLNCFTCMVCNKQLSTGEELYVIDENKFVCKDDYLSSSSLKEGSLNSVSSCTDRSLSPDLQDALQDDPKETDNSTSSDKETANNENEEQNSGTKRRGPRTTIKAKQLETLKAAFAATPKPTRHIREQLAQETGLNMRVIQVWFQNRRSKERRMKQLSALGARRHAFFRSPRRMRPLGGRLDESEMLGSTPYTYYGDYQGDYYAPGSNYDFFAHGPPSQAQSPADSSFLAASGPGSTPLGALEPPLAGPHAADNPRFTDMISHPDTPSPEPGLPGTLHPMPGEVFSGGPSPPFPMSGTSGYSGPLSHPNPELNEAAVW

SEQ ID NO: 46818 - protein, 377 aa, Homo sapiens
  Payload ID: 9469
  Gene Symbol: LHX6
  Gene Name: LIM homeobox 6
  Uniprot ID: Q9UPM6
  ENSP ID: ENSP00000340137
MYWKHENAAPALPEGCRLPAEGGPATDQVMAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESHPFSVLTLPALPHLPVGAPQLPLSR

SEQ ID NO: 46819 - protein, 348 aa, Homo sapiens
  Payload ID: 9469
  Gene Symbol: LHX6
  Gene Name: LIM homeobox 6
  Uniprot ID: Q9UPM6
  ENSP ID: ENSP00000362859
MAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESHPFSVLTLPALPHLPVGAPQLPLSR

SEQ ID NO: 46820 - protein, 363 aa, Homo sapiens
  Payload ID: 9469
  Gene Symbol: LHX6
  Gene Name: LIM homeobox 6
  Uniprot ID: Q9UPM6
  ENSP ID: ENSP00000362860
MAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESQVQCGQVHCRLPYTAPPVHLKADMDGPLSNRGEKVILFQY

SEQ ID NO: 46821 - protein, 392 aa, Homo sapiens
  Payload ID: 9469
  Gene Symbol: LHX6
  Gene Name: LIM homeobox 6
  Uniprot ID: Q9UPM6
  ENSP ID: ENSP00000377854
MYWKHENAAPALPEGCRLPAEGGPATDQVMAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESQVQCGQVHCRLPYTAPPVHLKADMDGPLSNRGEKVILFQY

SEQ ID NO: 46822 - protein, 366 aa, Homo sapiens
  Payload ID: 9469
  Gene Symbol: LHX6
  Gene Name: LIM homeobox 6
  Uniprot ID: Q9UPM6
  ENSP ID: ENSP00000441464
MRRGLCRRSAENPDAGPVMAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESHPFSVLTLPALPHLPVGAPQLPLSR

SEQ ID NO: 46823 - protein, 35 aa, Homo sapiens
  Payload ID: 9469
  Gene Symbol: LHX6
  Gene Name: LIM homeobox 6
  ENSP ID: ENSP00000452811
MVTLHGYIESHPFSVLTLPALPHLPVGAPQLPLSR

SEQ ID NO: 46824 - protein, 33 aa, Homo sapiens
  Payload ID: 9469
  Gene Symbol: LHX6
  Gene Name: LIM homeobox 6
  ENSP ID: ENSP00000453606
MAQPGSGCKATTRCLEGTAPPAMAQSDAEALAG

SEQ ID NO: 46825 - protein, 50 aa, Homo sapiens
  Payload ID: 9469
  Gene Symbol: LHX6
  Gene Name: LIM homeobox 6
  ENSP ID: ENSP00000453798
MVTLHGYIESQVQCGQVHCRLPYTAPPVHLKADMDGPLSNRGEKVILFQY

SEQ ID NO: 46826 - protein, 176 aa, Homo sapiens
  Payload ID: 9469
  Gene Symbol: LHX6
  Gene Name: LIM homeobox 6
  Uniprot ID: Q9UPM6
  ENSP ID: ENSP00000475927
MIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESQVQCGQVHCRLPYTAPPVHLKADMDGPLSNRGEKVILFQY

SEQ ID NO: 46827 - protein, 356 aa, Homo sapiens
  Payload ID: 9470
  Gene Symbol: LHX8
  Gene Name: LIM homeobox 8
  Uniprot ID: Q68G74
  ENSP ID: ENSP00000294638
MQILSRCQGLMSEECGRTTALAAGRTRKGAGEEGLVSPEGAGDEDSCSSSAPLSPSSSPRSMASGSGCPPGKCVCNSCGLEIVDKYLLKVNDLCWHVRCLSCSVCRTSLGRHTSCYIKDKDIFCKLDYFRRYGTRCSRCGRHIHSTDWVRRAKGNVYHLACFACFSCKRQLSTGEEFALVEEKVLCRVHYDCMLDNLKREVENGNGISVEGALLTEQDVNHPKPAKRARTSFTADQLQVMQAQFAQDNNPDAQTLQKLAERTGLSRRVIQVWFQNCRARHKKHVSPNHSSSTPVTAVPPSRLSPPMLEEMAYSAYVPQDGTMLTALHSYMDAHSPTTLGLQPLLPHSMTQLPISHT

SEQ ID NO: 46828 - protein, 346 aa, Homo sapiens
  Payload ID: 9470
  Gene Symbol: LHX8
  Gene Name: LIM homeobox 8
  Uniprot ID: Q68G74
  ENSP ID: ENSP00000348597
MSEECGRTTALAAGRTRKGAGEEGLVSPEGAGDEDSCSSSAPLSPSSSPRSMASGSGCPPGKCVCNSCGLEIVDKYLLKVNDLCWHVRCLSCSVCRTSLGRHTSCYIKDKDIFCKLDYFRRYGTRCSRCGRHIHSTDWVRRAKGNVYHLACFACFSCKRQLSTGEEFALVEEKVLCRVHYDCMLDNLKREVENGNGISVEGALLTEQDVNHPKPAKRARTSFTADQLQVMQAQFAQDNNPDAQTLQKLAERTGLSRRVIQVWFQNCRARHKKHVSPNHSSSTPVTAVPPSRLSPPMLEEMAYSAYVPQDGTMLTALHSYMDAHSPTTLGLQPLLPHSMTQLPISHT

SEQ ID NO: 46829 - protein, 397 aa, Homo sapiens
  Payload ID: 9471
  Gene Symbol: LHX9
  Gene Name: LIM homeobox 9
  Uniprot ID: Q9NQ69
  ENSP ID: ENSP00000356357
MEIVGCRAEDNSCPFRPPAMLFHGISGGHIQGIMEEMERRSKTEARLAKGAQLNGRDAGMPPLSPEKPALCAGCGGKISDRYYLLAVDKQWHLRCLKCCECKLALESELTCFAKDGSIYCKEDYYRRFSVQRCARCHLGISASEMVMRARDSVYHLSCFTCSTCNKTLTTGDHFGMKDSLVYCRAHFETLLQGEYPPQLSYTELAAKSGGLALPYFNGTGTVQKGRPRKRKSPALGVDIVNYNSGCNENEADHLDRDQQPYPPSQKTKRMRTSFKHHQLRTMKSYFAINHNPDAKDLKQLAQKTGLTKRVLQVWFQNARAKFRRNLLRQENGGVDKADGTSLPAPPSADSGALTPPGTATTLTDLTNPTITVVTSVTSNMDSHESGSPSQTTLTNLF

SEQ ID NO: 46830 - protein, 54 aa, Homo sapiens
  Payload ID: 9471
  Gene Symbol: LHX9
  Gene Name: LIM homeobox 9
  ENSP ID: ENSP00000356358
MLFHGISGGHIQGIMEEMERRSKTEARLAKGAQLNGRDAASPRRGSAAPRASWA

SEQ ID NO: 46831 - protein, 388 aa, Homo sapiens
  Payload ID: 9471
  Gene Symbol: LHX9
  Gene Name: LIM homeobox 9
  Uniprot ID: Q9NQ69
  ENSP ID: ENSP00000356360
MLNGTTLEAAMLFHGISGGHIQGIMEEMERRSKTEARLAKGAQLNGRDAGMPPLSPEKPALCAGCGGKISDRYYLLAVDKQWHLRCLKCCECKLALESELTCFAKDGSIYCKEDYYRRFSVQRCARCHLGISASEMVMRARDSVYHLSCFTCSTCNKTLTTGDHFGMKDSLVYCRAHFETLLQGEYPPQLSYTELAAKSGGLALPYFNGTGTVQKGRPRKRKSPALGVDIVNYNSGCNENEADHLDRDQQPYPPSQKTKRMRTSFKHHQLRTMKSYFAINHNPDAKDLKQLAQKTGLTKRVLQVWFQNARAKFRRNLLRQENGGVDKADGTSLPAPPSADSGALTPPGTATTLTDLTNPTITVVTSVTSNMDSHESGSPSQTTLTNLF

SEQ ID NO: 46832 - protein, 321 aa, Homo sapiens
  Payload ID: 9471
  Gene Symbol: LHX9
  Gene Name: LIM homeobox 9
  Uniprot ID: Q9NQ69
  ENSP ID: ENSP00000356361
MLNGTTLEAAMLFHGISGGHIQGIMEEMERRSKTEARLAKGAQLNGRDAGMPPLSPEKPALCAGCGGKISDRYYLLAVDKQWHLRCLKCCECKLALESELTCFAKDGSIYCKEDYYRRFSVQRCARCHLGISASEMVMRARDSVYHLSCFTCSTCNKTLTTGDHFGMKDSLVYCRAHFETLLQGEYPPQLSYTELAAKSGGLALPYFNGTGTVQKGRPRKRKSPALGVDIVNYNSGCNENEADHLDRDQQPYPPSQKTKRMRTSFKHHQLRTMKSYFAINHNPDAKDLKQLAQKTGLTKRVLQGEQILGHYSQTSRRLKIP

SEQ ID NO: 46833 - protein, 336 aa, Homo sapiens
  Payload ID: 9471
  Gene Symbol: LHX9
  Gene Name: LIM homeobox 9
  ENSP ID: ENSP00000453064
MQTLQTPSPLRMKPASSRVSGPQEAMLFHGISGGHIQGIMEEMERRSKTEARLAKGAQLNGRDAGMPPLSPEKPALCAGCGGKISDRYYLLAVDKQWHLRCLKCCECKLALESELTCFAKDGSIYCKEDYYRRFSVQRCARCHLGISASEMVMRARDSVYHLSCFTCSTCNKTLTTGDHFGMKDSLVYCRAHFETLLQGEYPPQLSYTELAAKSGGLALPYFNGTGTVQKGRPRKRKSPALGVDIVNYNSGCNENEADHLDRDQQPYPPSQKTKRMRTSFKHHQLRTMKSYFAINHNPDAKDLKQLAQKTGLTKRVLQGEQILGHYSQTSRRLKIP

SEQ ID NO: 46834 - protein, 26 aa, Homo sapiens
  Payload ID: 9471
  Gene Symbol: LHX9
  Gene Name: LIM homeobox 9
  ENSP ID: ENSP00000482898
MLFHGISGGHIQGIMEEMERRSKTEA

SEQ ID NO: 46835 - protein, 37 aa, Homo sapiens
  Payload ID: 9471
  Gene Symbol: LHX9
  Gene Name: LIM homeobox 9
  ENSP ID: ENSP00000483170
MLFHGISGGHIQGIMEEMERRSKTEARLAKGAQLNGR

SEQ ID NO: 46836 - protein, 382 aa, Homo sapiens
  Payload ID: 9472
  Gene Symbol: LMX1A
  Gene Name: LIM homeobox transcription factor 1, alpha
  Uniprot ID: Q8TE12
  ENSP ID: ENSP00000294816
MLDGLKMEENFQSAIDTSASFSSLLGRAVSPKSVCEGCQRVILDRFLLRLNDSFWHEQCVQCASCKEPLETTCFYRDKKLYCKYDYEKLFAVKCGGCFEAIAPNEFVMRAQKSVYHLSCFCCCVCERQLQKGDEFVLKEGQLLCKGDYEKERELLSLVSPAASDSGKSDDEESLCKSAHGAGKGTAEEGKDHKRPKRPRTILTTQQRRAFKASFEVSSKPCRKVRETLAAETGLSVRVVQVWFQNQRAKMKKLARRQQQQQQDQQNTQRLSSAQTNGGGSAGMEGIMNPYTALPTPQQLLAIEQSVYSSDPFRQGLTPPQMPGDHMHPYGAEPLFHDLDSDDTSLSNLGDCFLATSEAGPLQSRVGNPIDHLYSMQNSYFTS

SEQ ID NO: 46837 - protein, 382 aa, Homo sapiens; identical to SEQ ID NO: 46836
  Payload ID: 9472
  Gene Symbol: LMX1A
  Gene Name: LIM homeobox transcription factor 1, alpha
  Uniprot ID: Q8TE12
  ENSP ID: ENSP00000340226

SEQ ID NO: 46838 - protein, 382 aa, Homo sapiens; identical to SEQ ID NO: 46836
  Payload ID: 9472
  Gene Symbol: LMX1A
  Gene Name: LIM homeobox transcription factor 1, alpha
  Uniprot ID: Q8TE12
  ENSP ID: ENSP00000356868

SEQ ID NO: 46839 - protein, 406 aa, Homo sapiens
  Payload ID: 9473
  Gene Symbol: LMX1B
  Gene Name: LIM homeobox transcription factor 1, beta
  Uniprot ID: O60663
  ENSP ID: ENSP00000347684
MDIATGPESLERCFPRGQTDCAKMLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQGEPGPGQGLGQEVLSSRMEGMMASYTPLAPPQQQIVAMEQSPYGSSDPFQQGLTPPQMPGNDSIFHDIDSDTSLTSLSDCFLGSSDVGSLQARVGNPIDRLYSMQSSYFAS

SEQ ID NO: 46840 - protein, 402 aa, Homo sapiens
  Payload ID: 9473
  Gene Symbol: LMX1B
  Gene Name: LIM homeobox transcription factor 1, beta
  Uniprot ID: O60663
  ENSP ID: ENSP00000362573
MDIATGPESLERCFPRGQTDCAKMLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQEVLSSRMEGMMASYTPLAPPQQQIVAMEQSPYGSSDPFQQGLTPPQMPGDHMNPYGNDSIFHDIDSDTSLTSLSDCFLGSSDVGSLQARVGNPIDRLYSMQSSYFAS

SEQ ID NO: 46841 - protein, 395 aa, Homo sapiens
  Payload ID: 9473
  Gene Symbol: LMX1B
  Gene Name: LIM homeobox transcription factor 1, beta
  Uniprot ID: O60663
  ENSP ID: ENSP00000436930
MDIATGPESLERCFPRGQTDCAKMLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQEVLSSRMEGMMASYTPLAPPQQQIVAMEQSPYGSSDPFQQGLTPPQMPGNDSIFHDIDSDTSLTSLSDCFLGSSDVGSLQARVGNPIDRLYSMQSSYFAS

SEQ ID NO: 46842 - protein, 383 aa, Homo sapiens
  Payload ID: 9473
  Gene Symbol: LMX1B
  Gene Name: LIM homeobox transcription factor 1, beta
  ENSP ID: ENSP00000453580
MLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQGEPGPGQGLGQEVLSSRMEGMMASYTPLAPPQQQIVAMEQSPYGSSDPFQQGLTPPQMPGNDSIFHDIDSDTSLTSLSDCFLGSSDVGSLQARVGNPIDRLYSMQSSYFAS

SEQ ID NO: 46843 - protein, 282 aa, Homo sapiens
  Payload ID: 9474
  Gene Symbol: LIX1
  Gene Name: limb and CNS expressed 1
  Uniprot ID: Q8N485
  ENSP ID: ENSP00000274382
MDRTLESLRHIIAQVLPHRDPALVFKDLNVVSMLQEFWESKQQQKAAFPSEGVVVYESLPAPGPPFVSYVTLPGGSCFGNFQCCLSRAEARRDAAKVALINSLFNELPSRRITKEFIMESVQEAVASTSGTLDDADDPSTSVGAYHYMLESNMGKTMLEFQELMTIFQLLHWNGSLKALRETKCSRQEVISYYSQYSLDEKMRSHMALDWIMKERDSPGIVSQELRMALRQLEEARKAGQELRFYKEKKEILSLALTQICSDPDTSSPSDDQLSLTALCGYH

SEQ ID NO: 46844 - protein, 63 aa, Homo sapiens
  Payload ID: 9474
  Gene Symbol: LIX1
  Gene Name: limb and CNS expressed 1
  ENSP ID: ENSP00000427469
MHKVNVVSMLQEFWESKQQQKAAFPSEGVVVYESLPAPGPPFVSYVTLPGGSCFGNFQCCLSR

SEQ ID NO: 46845 - protein, 337 aa, Homo sapiens
  Payload ID: 9475
  Gene Symbol: LIX1L
  Gene Name: limb and CNS expressed 1 like
  Uniprot ID: Q8IVB5
  ENSP ID: ENSP00000474487
METMRAQRLQPGVGTSGRGTLRALRPGVTGAAAATATPPAGPPPAPPPPAPPPPPLLLSGAPGLPLPPGAAGSPAVLREAVEAVVRSFAKHTQGYGRVNVVEALQEFWQMKQSRGADLKNGALVVYEMVPSNSPPYVCYVTLPGGSCFGSFQFCPTKAEARRSAAKIALMNSVFNEHPSRRITDEFIEKSVSEALASFNGNREEADNPNTGIGAFRFMLESNKGKSMLEFQELMTVFQLLHWNGSLKAMRERQCSRQEVLAHYSHRALDDDIRHQMALDWVSREQSVPGALSRELASTERELDEARLAGKELRFHKEKKDILVLAAGQLGNMHSSNC

SEQ ID NO: 46846 - protein, 105 aa, Homo sapiens
  Payload ID: 9476
  Gene Symbol: LBH
  Gene Name: limb bud and heart development
  Uniprot ID: Q53QV2
  ENSP ID: ENSP00000378733
MSIYFPIHCPDYLRSAKMTEVMMNTQPMEEIGLSPRKDGLSYQIFPDPSDFDRCCKLKDRLPSIVVEPTEGEVESGELRWPPEEFLVQEDEQDNCEETAKENKEQ

SEQ ID NO: 46847 - protein, 48 aa, Homo sapiens
  Payload ID: 9476
  Gene Symbol: LBH
  Gene Name: limb bud and heart development
  ENSP ID: ENSP00000384443
MSIYFPIHCPDYLRSAKMTEVMMNTQPMEEIGLSPRKDGLSYQDCEEP

SEQ ID NO: 46848 - protein, 52 aa, Homo sapiens
  Payload ID: 9476
  Gene Symbol: LBH
  Gene Name: limb bud and heart development
  ENSP ID: ENSP00000385409
MSIYFPIHCPDYLRSAKMTEVMMNTQPMEEIGLSPRKDGLSYQVNLPRPVRF

SEQ ID NO: 46849 - protein, 111 aa, Homo sapiens
  Payload ID: 9476
  Gene Symbol: LBH
  Gene Name: limb bud and heart development
  ENSP ID: ENSP00000385703
MQVSTSRPAAAGLSCPDYLRSAKMTEVMMNTQPMEEIGLSPRKDGLSYQIFPDPSDFDRCCKLKDRLPSIVVEPTEGEVESGELRWPPEEFLVQEDEQDNCEETAKENKEQ

SEQ ID NO: 46850 - protein, 88 aa, Homo sapiens
  Payload ID: 9476
  Gene Symbol: LBH
  Gene Name: limb bud and heart development
  ENSP ID: ENSP00000386106
MTEVMMNTQPMEEIGLSPRKDGLSYQIFPDPSDFDRCCKLKDRLPSIVVEPTEGEVESGELRWPPEEFLVQEDEQDNCEETAKENKEQ

SEQ ID NO: 46851 - protein, 43 aa, Homo sapiens
  Payload ID: 9476
  Gene Symbol: LBH
  Gene Name: limb bud and heart development
  ENSP ID: ENSP00000392167
MSIYFPIHCPDYLRSAKMTEVMMNTQPMEEIGLSPRKDGLSYQ

SEQ ID NO: 46852 - protein, 490 aa, Homo sapiens
  Payload ID: 9477
  Gene Symbol: LMBR1
  Gene Name: limb development membrane protein 1
  Uniprot ID: Q8WVP7
  ENSP ID: ENSP00000326604
MEGQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 46853 - protein, 284 aa, Homo sapiens
  Payload ID: 9477
  Gene Symbol: LMBR1
  Gene Name: limb development membrane protein 1
  ENSP ID: ENSP00000352392
MLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGLHKLHLPNTSRDSETAKPSVNGHQKAL

SEQ ID NO: 46854 - protein, 38 aa, Homo sapiens
  Payload ID: 9477
  Gene Symbol: LMBR1
  Gene Name: limb development membrane protein 1
  ENSP ID: ENSP00000392557
MEGQDEVSAREQHFHSQVRESTMNKKMKMPSSTGFRCF

SEQ ID NO: 46855 - protein, 63 aa, Homo sapiens
  Payload ID: 9477
  Gene Symbol: LMBR1
  Gene Name: limb development membrane protein 1
  ENSP ID: ENSP00000393928
MEGQDEVSAREQHFHSQVRESTICFLLFAILYVVSYFIITRYKRKSDEQEDEDAIVNRISYVF

SEQ ID NO: 46856 - protein, 77 aa, Homo sapiens
  Payload ID: 9477
  Gene Symbol: LMBR1
  Gene Name: limb development membrane protein 1
  ENSP ID: ENSP00000395754
MEGQDEVSAREQHFHSQVRESTICFLLFAILYVVSYFIITRYKRKSGNPSPHFRDFGHASSSCVTHSWDSVGSFSTH

SEQ ID NO: 46857 - protein, 48 aa, Homo sapiens
  Payload ID: 9477
  Gene Symbol: LMBR1
  Gene Name: limb development membrane protein 1
  ENSP ID: ENSP00000397698
MEGQDEVSAREQHFHSQVRESTICFLLFAILYVVSYFIITRYKRKSGK

SEQ ID NO: 46858 - protein, 45 aa, Homo sapiens
  Payload ID: 9477
  Gene Symbol: LMBR1
  Gene Name: limb development membrane protein 1
  ENSP ID: ENSP00000403052
GLWNLASLFSNLCLFVLMPFAFFFLESEGFAGLKKEGKMSRQNLV

SEQ ID NO: 46859 - protein, 529 aa, Homo sapiens
  Payload ID: 9477
  Gene Symbol: LMBR1
  Gene Name: limb development membrane protein 1
  ENSP ID: ENSP00000408256
GQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNVGMLCAGNPEVATGRQVPEEQAGQLLLGKWIQEGGDMIANPRLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 46860 - protein, 47 aa, Homo sapiens
  Payload ID: 9477
  Gene Symbol: LMBR1
  Gene Name: limb development membrane protein 1
  ENSP ID: ENSP00000413539
MEGQDEVSAREQHFHSQVRESTVVFEHVHSRSVSWGCFAFTLLNHQQ

SEQ ID NO: 46861 - protein, 52 aa, Homo sapiens
  Payload ID: 9477
  Gene Symbol: LMBR1
  Gene Name: limb development membrane protein 1
  ENSP ID: ENSP00000414795
MEGQDEVSAREQHFHSQVRESTICFLLFAILYVVSYFIITRYKRKSGSPSVP

SEQ ID NO: 46862 - protein, 489 aa, Homo sapiens
  Payload ID: 9478
  Gene Symbol: LMBR1L
  Gene Name: limb development membrane protein 1-like
  Uniprot ID: Q6UX01
  ENSP ID: ENSP00000267102
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 46863 - protein, 74 aa, Homo sapiens
  Payload ID: 9478
  Gene Symbol: LMBR1L
  Gene Name: limb development membrane protein 1-like
  ENSP ID: ENSP00000394677
MEAPDYEVLSVREQLFHERIRECIISTLLFATLYILCHIFLTRFKKPAEFTTVSSYKMGVTMSTYSIVWTKGDG

SEQ ID NO: 46864 - protein, 153 aa, Homo sapiens
  Payload ID: 9478
  Gene Symbol: LMBR1L
  Gene Name: limb development membrane protein 1-like
  ENSP ID: ENSP00000413785
MEAPDYEVLSVREQLFHERIRECIISTLLFATLYILCHIFLTRFKKPAEFTTGSSCAPLPWQLPWVLSCSCPSPSSAMRCCSPCLGTTTSSGSTAPSSMVCGSWKLLGASGTLFFSSPTCPSSSSCPLHISSLSLRALLAPERVSWAGSMRQW

SEQ ID NO: 46865 - protein, 141 aa, Homo sapiens
  Payload ID: 9478
  Gene Symbol: LMBR1L
  Gene Name: limb development membrane protein 1-like
  ENSP ID: ENSP00000446641
MKGRRRHTELDSRKEGRCRDGRREEPGDLISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTE

SEQ ID NO: 46866 - protein, 59 aa, Homo sapiens
  Payload ID: 9478
  Gene Symbol: LMBR1L
  Gene Name: limb development membrane protein 1-like
  ENSP ID: ENSP00000446718
MEAPDYEVLSVREQLFHERIRECIAGFPASQPFRGFPSEWSSQGFRGYLAAVPYALPAT

SEQ ID NO: 46867 - protein, 153 aa, Homo sapiens
  Payload ID: 9478
  Gene Symbol: LMBR1L
  Gene Name: limb development membrane protein 1-like
  ENSP ID: ENSP00000447240
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHVCTPLGLARMFSVTGKLLVKPRLLEDLEEQLYCSAFEEAALTR

SEQ ID NO: 46868 - protein, 469 aa, Homo sapiens
  Payload ID: 9478
  Gene Symbol: LMBR1L
  Gene Name: limb development membrane protein 1-like
  Uniprot ID: Q6UX01
  ENSP ID: ENSP00000447329
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 46869 - protein, 39 aa, Homo sapiens
  Payload ID: 9478
  Gene Symbol: LMBR1L
  Gene Name: limb development membrane protein 1-like
  ENSP ID: ENSP00000448128
  MOD_RES (1)..(1): Any amino acid
XCHIFLTRFKKPAEFTTVSSYKMGVTMSTYSIVWTKGDG

SEQ ID NO: 46870 - protein, 185 aa, Homo sapiens
  Payload ID: 9478
  Gene Symbol: LMBR1L
  Gene Name: limb development membrane protein 1-like
  ENSP ID: ENSP00000448147
  MOD_RES (1)..(1): Any amino acid
XKRRKASAWQRNLGYPLAMLCLLVLTGLSVLIVAIHILELLIDEAAMPRGMQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 46871 - protein, 125 aa, Homo sapiens
  Payload ID: 9478
  Gene Symbol: LMBR1L
  Gene Name: limb development membrane protein 1-like
  ENSP ID: ENSP00000448821
GLSVLIVAIHILELLIDEAAMPRGMQGTSLGQVSFSKLGSFGAVIQVVLIFYLMVSSVVGFYSSPLFRSLRPRWHDTAMTQIIGNCVCLLVLSSALPVFSRTLGLDRLPLPVSGFPQASRKTQHQ

SEQ ID NO: 46872 - protein, 74 aa, Homo sapiens; identical to SEQ ID NO: 46863
  Payload ID: 9478
  Gene Symbol: LMBR1L
  Gene Name: limb development membrane protein 1-like
  ENSP ID: ENSP00000448973

SEQ ID NO: 46873 - protein, 79 aa, Homo sapiens
  Payload ID: 9478
  Gene Symbol: LMBR1L
  Gene Name: limb development membrane protein 1-like
  ENSP ID: ENSP00000449103
MEAPDYEVLSVREQLFHERIRECIISTLLFATLYILCHIFLTRFKKPAEFTTGLWNLVFLFSNLSLIFLMPFAYFFTES

SEQ ID NO: 46874 - protein, 126 aa, Homo sapiens
  Payload ID: 9478
  Gene Symbol: LMBR1L
  Gene Name: limb development membrane protein 1-like
  ENSP ID: ENSP00000449633
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIF

SEQ ID NO: 46875 - protein, 49 aa, Homo sapiens
  Payload ID: 9478
  Gene Symbol: LMBR1L
  Gene Name: limb development membrane protein 1-like
  ENSP ID: ENSP00000450032
MEAPDYEVLSVREQLFHERIRECIARAVHLYPGNCPGCCPAPALLHHQQ

SEQ ID NO: 46876 - protein, 92 aa, Homo sapiens
  Payload ID: 9478
  Gene Symbol: LMBR1L
  Gene Name: limb development membrane protein 1-like
  ENSP ID: ENSP00000450362
AWQRNLGYPLAMLCLLVLTGLSVLIVAIHILELLIDEAAMPRGMQVVLILYPSGNPSLPLFSKPVSWDSRPSTSWTFYLMVSSVVGFYSSPL

SEQ ID NO: 46877 - protein, 345 aa, Homo sapiens
  Payload ID: 9479
  Gene Symbol: LSAMP
  Gene Name: limbic system-associated membrane protein
  ENSP ID: ENSP00000328455
LRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFKRVLPTIPHPIQEIGTTVHFKQKGPGSVRGINGSISLAVPLWLLAASLLCLLSKC

SEQ ID NO: 46878 - protein, 205 aa, Homo sapiens
  Payload ID: 9479
  Gene Symbol: LSAMP
  Gene Name: limbic system-associated membrane protein
  ENSP ID: ENSP00000418506
MIVRLPQPCGTVSEKISSEVFSRNCAGGGSLRRKRKAGILEMVIFQLFHIHRSVSHGQQGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPT

SEQ ID NO: 46879 - protein, 338 aa, Homo sapiens
  Payload ID: 9479
  Gene Symbol: LSAMP
  Gene Name: limbic system-associated membrane protein
  Uniprot ID: Q13449
  ENSP ID: ENSP00000419000
MVRRVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 46880 - protein, 288 aa, Homo sapiens [sequence omitted]

SEQ ID NO: 46881 - protein, 209 aa, Homo sapiens
  Payload ID: 9480
  Gene Symbol: LIN28A
  Gene Name: lin-28 homolog A (C. elegans)
  Uniprot ID: Q9H9Z2
  ENSP ID: ENSP00000254231
MGSVSNQQFAGGCAKAAEEAPEEAPEDAARAADEPQLLHGAGICKWFNVRMGFGFLSMTARAGVALDPPVDVFVHQSKLHMEGFRSLKEGEAVEFTFKKSAKGLESIRVTGPGGVFCIGSERRPKGKSMQKRRSKGDRCYNCGGLDHHAKECKLPPQPKKCHFCQSISHMVASCPLKAQQGPSAQGKPTYFREEEEEIHSPTLLPEAQN

SEQ ID NO: 46882 - protein, 209 aa, Homo sapiens; identical to SEQ ID NO: 46881
  Payload ID: 9480
  Gene Symbol: LIN28A
  Gene Name: lin-28 homolog A (C. elegans)
  Uniprot ID: Q9H9Z2
  ENSP ID: ENSP00000363314

SEQ ID NO: 46883 - protein, 250 aa, Homo sapiens
  Payload ID: 9481
  Gene Symbol: LIN28B
  Gene Name: lin-28 homolog B (C. elegans)
  Uniprot ID: Q6ZN17
  ENSP ID: ENSP00000344401
MAEGGASKGGGEEPGKLPEPAEEESQVLRGTGHCKWFNVRMGFGFISMINREGSPLDIPVDVFVHQSKLFMEGFRSLKEGEPVEFTFKKSSKGLESIRVTGPGGSPCLGSERRPKGKTLQKRKPKGDRCYNCGGLDHHAKECSLPPQPKKCHYCQSIMHMVANCPHKNVAQPPASSQGRQEAESQPCTSTLPREVGGGHGCTSPPFPQEARAEISERSGRSPQEASSTKSSIAPEEQSKKGPSVQKRKKT

SEQ ID NO: 46884 - protein, 246 aa, Homo sapiens
  Payload ID: 9482
  Gene Symbol: LIN37
  Gene Name: lin-37 DREAM MuvB core complex component
  Uniprot ID: Q96GY3
  ENSP ID: ENSP00000301159
MFPVKVKVEKSELEMAKARNQLDAVLQCLLEKSHMDRERLDEEAGKTPSDTHNKDCSIAATGKRPSARFPHQRRKKRREMDDGLAEGGPQRSNTYVIKLFDRSVDLAQFSENTPLYPICRAWMRNSPSVRERECSPSSPLPPLPEDEEGSEVTNSKSRDVYKLPPPTPPGPPGDACRSRIPSPLQPEMQGTPDDEPSEPEPSPSTLIYRNMQRWKRIRQRWKEASHRNQLRYSESMKILREMYERQ

SEQ ID NO: 46885 - protein, 19 aa, Homo sapiens
  Payload ID: 9482
  Gene Symbol: LIN37
  Gene Name: lin-37 DREAM MuvB core complex component
  ENSP ID: ENSP00000466160
MAKARNQLDAVLQCLLEKS

SEQ ID NO: 46886 - protein, 163 aa, Homo sapiens
  Payload ID: 9482
  Gene Symbol: LIN37
  Gene Name: lin-37 DREAM MuvB core complex component
  ENSP ID: ENSP00000466707
  MOD_RES (1)..(1): Any amino acid
XPSARFPHQRRKKRREMDDGLAEGGPQRSNTYVIKLFDRSVDLAQFSENTPLYPICRAWMRNSPSGSEVTNSKSRDVYKLPPPTPPGPPGDACRSRIPSPLQPEMQGTPDDEPSEPEPSPSTLIYRNMQRWKRIRQRWKEASHRNQLRYSESMKILREMYERQ

SEQ ID NO: 46887 - protein, 54 aa, Homo sapiens
  Payload ID: 9482
  Gene Symbol: LIN37
  Gene Name: lin-37 DREAM MuvB core complex component
  ENSP ID: ENSP00000469928
MFPVKVKVEKSELEMAKARNQLDAVLQCLLEKSHMDRERLDEEAGKTPSDTHNK

SEQ ID NO: 46888 - protein, 116 aa, Homo sapiens
  Payload ID: 9483
  Gene Symbol: LIN52
  Gene Name: lin-52 DREAM MuvB core complex component
  Uniprot ID: Q52LA3
  ENSP ID: ENSP00000451812
MGWKMASPTDGTDLEASLLSFEKLDRASPDLWPEQLPGVAEFAASFKSPITSSPPKWMAEIERDDIDMLKELGSLTTANLMEKVRGLQNLAYQLGLDESREMTRGKFLNILEKPKK

SEQ ID NO: 46889 - protein, 97 aa, Homo sapiens
  Payload ID: 9483
  Gene Symbol: LIN52
  Gene Name: lin-52 DREAM MuvB core complex component
  ENSP ID: ENSP00000452513
  MOD_RES (1)..(1): Any amino acid
XRDMGWKMASPTDGTDLEASLLSFEKLDRASPDLWPEQFLFFFLVPGVAEFAASFKSPITSSPPKWMAEIERDDIDMLKAREMTRGKFLNILEKPKK

SEQ ID NO: 46890 - protein, 749 aa, Homo sapiens
  Payload ID: 9484
  Gene Symbol: LIN54
  Gene Name: lin-54 DREAM MuvB core complex component
  Uniprot ID: Q6MZP7
  ENSP ID: ENSP00000341947
MEVVPAEVNSLLPEEIMDTGITLVDDDSIEAVIVSSPIPMETELEEIVNINSTGDSTATPISTEPITVYSNHTNQVAVNTTITKADSNTTVKPAFPSGLQKLGAQTPVTISANQIILNKVSQTSDLKLGNQTLKPDGQKLILTTLGKSGSPIVLALPHSQLPQAQKVTTQAQSGDAKLPPQQIKVVTIGGRPEVKPVIGVSALTPGSQLINTTTQPSVLQTQQLKTVQIAKKPRTPTSGPVITKLIFAKPINSKAVTGQTTQVSPPVIAGRVLSQSTPGTPSKTITISESGVIGSTLNSTTQTPNKIAISPLKSPNKAVKSTVQTITVGGVSTSQFKTIIPLATAPNVQQIQVPGSKFHYVRLVTATSASSSTQPVSQNPSTNTQPLQQAKPVVVNTTPVRMSVPIVSAQAVKQVVPKPINPTSQIVTTSQPQQRLIMPATPLPQIQPNLTNLPPGTVLAPAPGTGNVGYAVLPAQYVTQLQQSSYVSIASNSTFTGTSGIQTQARLPFNGIIPSESASRPRKPCNCTKSLCLKLYCDCFANGEFCNNCNCTNCYNNLEHENERQKAIKACLDRNPEAFKPKIGKGKEGESDRRHSKGCNCKRSGCLKNYCECYEAKIMCSSICKCIGCKNFEESPERKTLMHLADAAEVRVQQQTAAKTKLSSQISDLLTRPTPALNSGGGKLPFTFVTKEVAEATCNCLLAQAEQADKKGKSKAAAERMILEEFGRCLMSVINSAGKAKSDPCAMNC

SEQ ID NO: 46891 - protein, 528 aa, Homo sapiens
  Payload ID: 9484
  Gene Symbol: LIN54
  Gene Name: lin-54 DREAM MuvB core complex component
  Uniprot ID: Q6MZP7
  ENSP ID: ENSP00000398265
MEVVPAEIAKKPRTPTSGPVITKLIFAKPINSKAVTGQTTQVSPPVIAGRVLSQSTPGTPSKTITISESGVIGSTLNSTTQTPNKIAISPLKSPNKAVKSTVQTITVGGVSTSQFKTIIPLATAPNVQQIQVPGSKFHYVRLVTATSASSSTQPVSQNPSTNTQPLQQAKPVVVNTTPVRMSVPIVSAQAVKQVVPKPINPTSQIVTTSQPQQRLIMPATPLPQIQPNLTNLPPGTVLAPAPGTGNVGYAVLPAQYVTQLQQSSYVSIASNSTFTGTSGIQTQARLPFNGIIPSESASRPRKPCNCTKSLCLKLYCDCFANGEFCNNCNCTNCYNNLEHENERQKAIKACLDRNPEAFKPKIGKGKEGESDRRHSKGCNCKRSGCLKNYCECYEAKIMCSSICKCIGCKNFEESPERKTLMHLADAAEVRVQQQTAAKTKLSSQISDLLTRPTPALNSGGGKLPFTFVTKEVAEATCNCLLAQAEQADKKGKSKAAAERMILEEFGRCLMSVINSAGKAKSDPCAMNC

SEQ ID NO: 46892 - protein, 528 aa, Homo sapiens; identical to SEQ ID NO: 46891
  Payload ID: 9484
  Gene Symbol: LIN54
  Gene Name: lin-54 DREAM MuvB core complex component
  Uniprot ID: Q6MZP7
  ENSP ID: ENSP00000407139

SEQ ID NO: 46893 - protein, 528 aa, Homo sapiens; identical to SEQ ID NO: 46891
  Payload ID: 9484
  Gene Symbol: LIN54
  Gene Name: lin-54 DREAM MuvB core complex component
  Uniprot ID: Q6MZP7
  ENSP ID: ENSP00000421045

SEQ ID NO: 46894 - protein, 62 aa, Homo sapiens
  Payload ID: 9484
  Gene Symbol: LIN54
  Gene Name: lin-54 DREAM MuvB core complex component
  ENSP ID: ENSP00000421651
MEVVPAEIAKKPRTPTSGPVITKLIFAKPINSKAVTGQTTQVSPPVIAGFFHSLLPELHQRP

SEQ ID NO: 46895 - protein, 660 aa, Homo sapiens
  Payload ID: 9484
  Gene Symbol: LIN54
  Gene Name: lin-54 DREAM MuvB core complex component
  Uniprot ID: Q6MZP7
  ENSP ID: ENSP00000423475
MEVVPAEVNSLLPEEIMDTGITLVDDDSIEAVIVSSPIPMETELEEIVNINSTGDSTATPISTEPITVYSNHTNQVAVNTTITKADSNTTVKPAFPSGLQKLGAQTPVTISANQIILNKVSQTSDLKLGNQTLKPDGQKLILTTLGKSGSPIVLALPHSQLPQAQKVTTQAQSGDAKLPPQQIKVVTIGGRPEVKPVIGVSALTPGSQLINTTTQPSVLQTQQLKTVQAVKSTVQTITVGGVSTSQFKTIIPLATAPNVQQIQVPGSKFHYVRLVTATSASSSTQPVSQNPSTNTQPLQQAKPVVVNTTPVRMSVPIVSAQAVKQVVPKPINPTSQIVTTSQPQQRLIMPATPLPQIQPNLTNLPPGTVLAPAPGTGNVGYAVLPAQYVTQLQQSSYVSIASNSTFTGTSGIQTQARLPFNGIIPSESASRPRKPCNCTKSLCLKLYCDCFANGEFCNNCNCTNCYNNLEHENERQKAIKACLDRNPEAFKPKIGKGKEGESDRRHSKGCNCKRSGCLKNYCECYEAKIMCSSICKCIGCKNFEESPERKTLMHLADAAEVRVQQQTAAKTKLSSQISDLLTRPTPALNSGGGKLPFTFVTKEVAEATCNCLLAQAEQADKKGKSKAAAERMILEEFGRCLMSVINSAGKAKSDPCAMNC

SEQ ID NO: 46896 - protein, 749 aa, Homo sapiens; identical to SEQ ID NO: 46890
  Payload ID: 9484
  Gene Symbol: LIN54
  Gene Name: lin-54 DREAM MuvB core complex component
  Uniprot ID: Q6MZP7
  ENSP ID: ENSP00000425844

SEQ ID NO: 46897 - protein, 243 aa, Homo sapiens
  Payload ID: 9484
  Gene Symbol: LIN54
  Gene Name: lin-54 DREAM MuvB core complex component
  Uniprot ID: Q6MZP7
  ENSP ID: ENSP00000427413
MEVVPAEVNSLLPEEIMDTGITLVDDDSIEAVIVSSPIPMETELEEIVNINSTGDSTATPISTEPITVYSNHTNQVAVNTTITKADSNTTVKPAFPSGLQKLGAQTPVTISANQIILNKVSQTSDLKLGNQTLKPDGQKLILTTLGKSGSPIVLALPHSQLPQAQKVTTQAQSGDAKLPPQQIKVVTIGGRPEVKPVIGVSALTPGSQLINTTTQPSVLQTQQLKTVQVGFFHSLLPELHQRP

SEQ ID NO: 46898 - protein, 101 aa, Homo sapiens
  Payload ID: 9485
  Gene Symbol: LIN7A
  Gene Name: lin-7 homolog A (C. elegans)
  ENSP ID: ENSP00000261203
MLKPSVTSAPTADMATLTVVQPLTLDRDVARAIELLEKLQESGEVPVHKLQSLKKVLQSEFCTAIREVYQYMHETITVNGCPEFRARATAKVFSCVHCKRI

SEQ ID NO: 46899 - protein, 233 aa, Homo sapiens
  Payload ID: 9485
  Gene Symbol: LIN7A
  Gene Name: lin-7 homolog A (C. elegans)
  Uniprot ID: O14910
  ENSP ID: ENSP00000447488
MLKPSVTSAPTADMATLTVVQPLTLDRDVARAIELLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVSVEGEHHEKAVELLKAAKDSVKLVVRYTPKVLEEMEARFEKLRTARRRQQQQLLIQQQQQQQQQQTQQNHMS

SEQ ID NO: 46900 - protein, 130 aa, Homo sapiens
  Payload ID: 9485
  Gene Symbol: LIN7A
  Gene Name: lin-7 homolog A (C. elegans)
  ENSP ID: ENSP00000448891
  MOD_RES (1)..(1): Any amino acid
XLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVVCL

SEQ ID NO: 46901 - protein, 180 aa, Homo sapiens
  Payload ID: 9485
  Gene Symbol: LIN7A
  Gene Name: lin-7 homolog A (C. elegans)
  ENSP ID: ENSP00000448975
TSAPTADMATLTVVQPLTLDRDVARAIELLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVLLRSQKQMETHVSSAIIGRENFFYP

SEQ ID NO: 46902 - protein, 207 aa, Homo sapiens
  Payload ID: 9486
  Gene Symbol: LIN7B
  Gene Name: lin-7 homolog B (C. elegans)
  Uniprot ID: Q9HAP6
  ENSP ID: ENSP00000221459
MAALVEPLGLERDVSRAVELLERLQRSGELPPQKLQALQRVLQSRFCSAIREVYEQLYDTLDITGSAEIRAHATAKATVAAFTASEGHAHPRVVELPKTDEGLGFNIMGGKEQNSPIYISRVIPGGVADRHGGLKRGDQLLSVNGVSVEGEQHEKAVELLKAAQGSVKLVVRYTPRVLEEMEARFEKMRSARRRQQHQSYSSLESRG

SEQ ID NO: 46903 - protein, 137 aa, Homo sapiens
  Payload ID: 9486
  Gene Symbol: LIN7B
  Gene Name: lin-7 homolog B (C. elegans)
  Uniprot ID: Q9HAP6
  ENSP ID: ENSP00000375737
MAALVEPLGLERDVSRAVELLERLQRSGELPPQKLQALQRVLQSRFCSAIREVYEQLYDTLDITGSAEIRAHATAKSVEGEQHEKAVELLKAAQGSVKLVVRYTPRVLEEMEARFEKMRSARRRQQHQSYSSLESRG

SEQ ID NO: 46904 - protein, 132 aa, Homo sapiens
  Payload ID: 9486
  Gene Symbol: LIN7B
  Gene Name: lin-7 homolog B (C. elegans)
  ENSP ID: ENSP00000472804
  MOD_RES (1)..(1): Any amino acid
XALVEPLGLERDVSRAVELLERLQRSGELPPQKLQALQRVLQSRFCSAIREVYEQLYDTLDITGSAEIRAHATAKKYKKKKKERKSRAWWRVPVIPAGLQLRRLRQENRLNPGGRGCSEPRSCHCTPAWATE

SEQ ID NO: 46905 - protein, 115 aa, Homo sapiens
  Payload ID: 9486
  Gene Symbol: LIN7B
  Gene Name: lin-7 homolog B (C. elegans)
  ENSP ID: ENSP00000474643
  MOD_RES (1)..(1): Any amino acid
XLGLERDVSRAVELLERLQRSGELPPQKLQALQRVLQSRFCSAIREVYEQLYDTLDITGSAEIRAHATAKVGPAPHCSWCLFNCLVELNISFMPVISVSSLMIFAKSMCHLTISK

SEQ ID NO: 46906 - protein, 197 aa, Homo sapiens
  Payload ID: 9487
  Gene Symbol: LIN7C
  Gene Name: lin-7 homolog C (C. elegans)
  Uniprot ID: Q9NUP9
  ENSP ID: ENSP00000278193
MAALGEPVRLERDICRAIELLEKLQRSGEVPPQKLQALQRVLQSEFCNAVREVYEHVYETVDISSSPEVRANATAKATVAAFAASEGHSHPRVVELPKTEEGLGFNIMGGKEQNSPIYISRIIPGGIADRHGGLKRGDQLLSVNGVSVEGEHHEKAVELLKAAQGKVKLVVRYTPKVLEEMESRFEKMRSAKRRQQT

SEQ ID NO: 46907 - protein, 173 aa, Homo sapiens
  Payload ID: 9487
  Gene Symbol: LIN7C
  Gene Name: lin-7 homolog C (C. elegans)
  ENSP ID: ENSP00000435353
MAALGEPVRLERDICRAIELLEKLQRSGEVPPQKLQALQRVLQSEFCNAVREATVAAFAASEGHSHPRVVELPKTEEGLGFNIMGGKEQNSPIYISRIIPGGIADRHGGLKRGDQLLSVNGVSVEGEHHEKAVELLKAAQGKVKLVVRYTPKVLEEMESRFEKMRSAKRRQQT

SEQ ID NO: 46908 - protein, 558 aa, Homo sapiens
  Payload ID: 9488
  Gene Symbol: LIN9
  Gene Name: lin-9 DREAM MuvB core complex component
  Uniprot ID: Q5TKA1
  ENSP ID: ENSP00000329102
MHRGGQPLKKRRGSFKMAELDQLPDESSSAKALVSLKEGSLSNTWNEKYSSLQKTPVWKGRNTSSAVEMPFRNSKRSRLFSDEDDRQINTRSPKRNQRVAMVPQKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMIKKEHIKKLREMNTEAEKLKSYSMPISIEFQRRYATIVLELEQLNKDLNKVLHKVQQYCYELAPDQGLQPADQPTDMRRRCEEEAQEIVRHANSSTGQPCVENENLTDLISRLTAILLQIKCLAEGGDLNSFEFKSLTDSLNDIKSTIDASNISCFQNNVEIHVAHIQSGLSQMGNLHAFAANNTNRD

SEQ ID NO: 46909 - protein, 71 aa, Homo sapiens
  Payload ID: 9488
  Gene Symbol: LIN9
  Gene Name: lin-9 DREAM MuvB core complex component
  ENSP ID: ENSP00000352515
MPFRNSKRSRLFSDEDDRQINTRSPKRNQRVAMVPQKFTATMSTPDKKASQKIGFRLRNLLKLPKAHKWCI

SEQ ID NO: 46910 - protein, 613 aa, Homo sapiens
  Payload ID: 9488
  Gene Symbol: LIN9
  Gene Name: lin-9 DREAM MuvB core complex component
  ENSP ID: ENSP00000355773
ETAEQNSSLAVGLNDQLHDLSRSRSPAARSSASNIRERRARIARGRWDRVPDVATRRGLLRPAVSGKVRGRRRPSNVGFGNCSSAKALVSLKEGSLSNTWNEKYSSLQKTPVWKGRNTSSAVEMPFRNSKRSRLFSDEDDRQINTRSPKRNQRVAMVPQKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMIKKEHIKKLREMNTEAEKLKSYSMPISIEFQRRYATIVLELEQLNKDLNKVLHKVQQYCYELAPDQGLQPADQPTDMRRRCEEEAQEIVRHANSSTGQPCVENENLTDLISRLTAILLQIKCLAEGGDLNSFEFKSLTDSLNDIKSTIDASNISCFQNNVEIHVAHIQSGLSQMGNLHAFAANNTNRD

SEQ ID NO: 46911 - protein, 518 aa, Homo sapiens
  Payload ID: 9488
  Gene Symbol: LIN9
  Gene Name: lin-9 DREAM MuvB core complex component
  ENSP ID: ENSP00000418121
QPLKKRRGSFKMAELDQLPDESSSAKALVSLKEGSLSNTWNEKYSSLQKTPVWKGRNTSSAVEMKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMIKKEHIKKLREMNTEAEKLKSYSMPISIEFQRRYATIVLELEQLNKDLNKVLHKVQQYCYELAPDQGLQPADQPTDMRRRCEEEAQEIVRHANSSTGQPCVENENLTDLISRLTAILLQIKCLAEGGDLNSFEFKSLTDSLNDIKSTIDASNISCFQNNVEIHVAHIQSGLSQMGNLHAFAANNTNRD

SEQ ID NO: 46912 - protein, 489 aa, Homo sapiens
  Payload ID: 9488
  Gene Symbol: LIN9
  Gene Name: lin-9 DREAM MuvB core complex component
  ENSP ID: ENSP00000418489
MHRGGQPLKKRRGSFKMAELDQLPDESSSAKALVSLKEGSLSNTWNEKYSSLQKTPVWKGRNTSSAVEMKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMIKKEHIKKLREMNTEAEKLKSYSMPISIEFQRRYATIVLELEQLNKDLNKVLHKVQQYCYELAPDQGLQPADQPTDMRRRCEEEAQEIVRHANSSTGQPCVENENLTDLISRLTAILLQIKCLAEGGDLNSFEFKSLTDSLNDIKSTIDASNIR

SEQ ID NO: 46913 - protein, 865 aa, Homo sapiens
  Payload ID: 9489
  Gene Symbol: L1TD1
  Gene Name: LINE-1 type transposase domain containing 1
  Uniprot ID: Q5T7N2
  ENSP ID: ENSP00000419901
MSDVSTSVQSKFARLAKKKENITYMKREQLTETDKDIAPVLDLKCKDVSAIMNKFKVLMEIQDLMFEEMRETLKNDLKAVLGGKATIPEVKNSENSSSRTEFQQIINLALQKTGMVGKIEGENSKIGDDNENLTFKLEVNELSGKLDNTNEYNSNDGKKLPQGESRSYEVMGSMEETLCNIDDRDGNRNVHLEFTERESRKDGEDEFVKEMREERKFQKLKNKEEVLKASREEKVLMDEGAVLTLVADLSSATLDISKQWSNVFNILRENDFEPKFLCEVKLAFKCDGEIKTFSDLQSLRKFASQKSSVKELLKDVLPQKEEINQGGRKYGIQEKRDKTLIDSKHRAGEITSDGLSFLFLKEVKVAKPEEMKNLETQEEEFSELEELDEEASGMEDDEDTSGLEEEEEEPSGLEEEEEEEASGLEEDEASGLEEEEEQTSEQDSTFQGHTLVDAKHEVEITSDGMETTFIDSVEDSESEEEEEGKSSETGKVKTTSLTEKKASRRQKEIPFSYLVGDSGKKKLVKHQVVHKTQEEEETAVPTSQGTGTPCLTLCLASPSKSLEMSHDEHKKHSHTNLSISTGVTKLKKTEEKKHRTLHTEELTSKEADLTEETEENLRSSVINSIREIKEEIGNLKSSHSGVLEIENSVDDLSSRMDILEERIDSLEDQIEEFSKDTMQMTKQIISKERQRDIEERSRSCNIRLIGIPEKESYENRAEDIIKEIIDENFAELKKGSSLEIVSACRVPSKIDEKRLTPRHILVKFWNSSDKEKIIRASRERREITYQGTRIRLTADLSLDTLDARSKWSNVFKVLLEKGFNPRILYPAKMAFDFRGKTKVFLSIEEFRDYVLHMPTLRELLGNNIP

SEQ ID NO: 46914 - protein, 757 aa, Homo sapiens
  Payload ID: 9490
  Gene Symbol: LINS1
  Gene Name: lines homolog 1
  Uniprot ID: Q8NG48
  ENSP ID: ENSP00000318423
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCLWTLTAIIKEIFKDSCSQKTEILKQFLTHFDTIFEVFYNSLFSQHFENCRDTSKIVNILMCFLDLLELLIASRIHLKLHFTCQRILFLKPSCMLEVITWPIQAFVKRKVIIFLKKCLLCKVGEDLCRGSVPALMPPDHHVAVDMLALANAVLQAVNSGLLKTLSVYEKHSFFGGDEVQPECELITSPDHVILRAASLVIMKSLEIKFQNYSSASEVKVDLQRFMSELLTFLKPHLQPSLQLHNPCKWLSRVFIEQDDDMLEAAKASLGIYLTLTRGCEATESLTQGKEMWDHHTHENGYNPHCIFLFFLKNIGFDSTVLLDFLISSETCFLEYFVRYLKLLQKDWDNFFTICNNFDATESKYDISICGCVPSLVQDQSSNQTIPHRLTAPHSHRDVCARHSWASDAPSEPLKAVMSKGAHTMCASSLSSPRASQSLVDYDSSDDSDVESTEQCLANSKQTSLHQQATKEIQDAAGTSRDKKEFSLEPPSRPLVLKEFDTAFSFDCEVAPNDVVSEVGIFYRIVKCFQELQDAICRLQKKNLFPYNPTALLKLLKYIEVISNKTMNTL

SEQ ID NO: 46915 - protein, 198 aa, Homo sapiens
  Payload ID: 9490
  Gene Symbol: LINS1
  Gene Name: lines homolog 1
  ENSP ID: ENSP00000452941
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCLWTLTAII

SEQ ID NO: 46916 - protein, 129 aa, Homo sapiens
  Payload ID: 9490
  Gene Symbol: LINS1
  Gene Name: lines homolog 1
  ENSP ID: ENSP00000453495
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKV

SEQ ID NO: 46917 - protein, 191 aa, Homo sapiens
  Payload ID: 9490
  Gene Symbol: LINS1
  Gene Name: lines homolog 1
  ENSP ID: ENSP00000453642
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCL

SEQ ID NO: 46918 - protein, 144 aa, Homo sapiens
  Payload ID: 9490
  Gene Symbol: LINS1
  Gene Name: lines homolog 1
  ENSP ID: ENSP00000453692
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLL

SEQ ID NO: 46919 - protein, 436 aa, Homo sapiens
  Payload ID: 9490
  Gene Symbol: LINS1
  Gene Name: lines homolog 1
  Uniprot ID: Q8NG48
  ENSP ID: ENSP00000454200
MKVFCEVLEELYKKVLLGATLENDSHDYIFYLNPAVSDQDCSTATSLEWANTCGIQGRHQPISVGVAPIAVAPVCLKTNSQMSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCLWTLTAIIKEIFKDSCSQKTEILKQFLTHFDTIFEVFYNSLFSQHFENCRDTSKIVNILMCFLDLLELLIASRIHLKLHFTCQRILFLKPSCMLEVITWPIQAFVKRKVIIFLKKCLLCKVGEDLCRGSVPALMPPDHHVAVDMLALANAVLQAVNSGLLKTLSVYEKHSFFGGDEVQPECELITSPDHVILRAASLVIMKSLEIKFQNYSSASEVKGNSPNSFCMQCVIIYLSTVIHNYQISGLV

SEQ ID NO: 46920 - protein, 317 aa, Homo sapiens
  Payload ID: 9490
  Gene Symbol: LINS1
  Gene Name: lines homolog 1
  ENSP ID: ENSP00000454929
MKVFCEVLEELYKKICMFQNSDKLLSHMAAQCLALLLYFQLREKITLSNSWIAFCQKNLSEYSESNKAIYCLWTLTAIIKEIFKDSCSQKTEILKQFLTHFDTIFEVFYNSLFSQHFENCRDTSKIVNILMCFLDLLELLIASRIHLKLHFTCQRILFLKPSCMLEVITWPIQAFVKRKVIIFLKKCLLCKVGEDLCRGSVPALMPPDHHVAVDMLALANAVLQAVNSGLLKTLSVYEKHSFFGGDEVQPECELITSPDHVILRAASLVIMKSLEIKFQNYSSASEVKGNSPNSFCMQCVIIYLSTVIHNYQISGLV

SEQ ID NO: 46921 - protein, 132 aa, Homo sapiens
  Payload ID: 9490
  Gene Symbol: LINS1
  Gene Name: lines homolog 1
  ENSP ID: ENSP00000454985
MSGSREVMLLQLTVIKVMTTRILSVKTEFHAKEQYRDVIKILLESAKVDSKLICMFQNSDKLLSHMAAQCLALLLYFQLREKITLSNSWIAFCQKNLSEYSESNKAIYCLWTLTAIIKEIFKDSCSQKTEIL

SEQ ID NO: 46922 - protein, 69 aa, Homo sapiens
  Payload ID: 9490
  Gene Symbol: LINS1
  Gene Name: lines homolog 1
  ENSP ID: ENSP00000474128
  MOD_RES (1)..(1): Any amino acid
XVNSGLLKTLSVYEKHSFFGGDEVQPECELITSPDHVILRAASLVIMKSLEIKFQNYSSASEVKDMEIK

SEQ ID NO: 46923 - protein, 262 aa, Homo sapiens
  Payload ID: 9491
  Gene Symbol: LAT
  Gene Name: linker for activation of T cells
  Uniprot ID: O43561
  ENSP ID: ENSP00000354119
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEGASGIRGAQAGWGVWGPSWTRLTPVSLPPEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 46924 - protein, 233 aa, Homo sapiens
  Payload ID: 9491
  Gene Symbol: LAT
  Gene Name: linker for activation of T cells
  Uniprot ID: O43561
  ENSP ID: ENSP00000378841
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 46925 - protein, 269 aa, Homo sapiens
  Payload ID: 9491
  Gene Symbol: LAT
  Gene Name: linker for activation of T cells
  Uniprot ID: O43561
  ENSP ID: ENSP00000378845
MEATAASWQVAVPVLGGASRPLGPRGAASLLRAPLQMEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 46926 - protein, 232 aa, Homo sapiens
  Payload ID: 9491
  Gene Symbol: LAT
  Gene Name: linker for activation of T cells
  Uniprot ID: O43561
  ENSP ID: ENSP00000398793
MEEAILVPCVLGLLLLPILAMLMALCVHCHRLPGSYDSTSSDSLYPRGIQFKRPHTVAPWPPAYPPVTSYPPLSQPDLLPIPSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 46927 - protein, 85 aa, Homo sapiens
  Payload ID: 9491
  Gene Symbol: LAT
  Gene Name: linker for activation of T cells
  ENSP ID: ENSP00000454793
MEEAILVPCVLGLLLLPILAMLMALCVHCHRLPGSYDSTSSDSLYPRGIQFKRPHTVAPWPPAYPPVTSYPPLSQPDLLPIPHDP

SEQ ID NO: 46928 - protein, 166 aa, Homo sapiens
  Payload ID: 9491
  Gene Symbol: LAT
  Gene Name: linker for activation of T cells
  ENSP ID: ENSP00000455728
IPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPVEAESVLEPGLPGTAELGSWKWLWGPHMASCPCSSLTTA

SEQ ID NO: 46929 - protein, 261 aa, Homo sapiens
  Payload ID: 9491
  Gene Symbol: LAT
  Gene Name: linker for activation of T cells
  Uniprot ID: O43561
  ENSP ID: ENSP00000456761
MEEAILVPCVLGLLLLPILAMLMALCVHCHRLPGSYDSTSSDSLYPRGIQFKRPHTVAPWPPAYPPVTSYPPLSQPDLLPIPSPQPLGGSHRTPSSRRDSDGANSVASYENEGASGIRGAQAGWGVWGPSWTRLTPVSLPPEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 46930 - protein, 232 aa, Homo sapiens; identical to SEQ ID NO: 46926
  Payload ID: 9491
  Gene Symbol: LAT
  Gene Name: linker for activation of T cells
  Uniprot ID: O43561
  ENSP ID: ENSP00000457036

SEQ ID NO: 46931 - protein, 85 aa, Homo sapiens; identical to SEQ ID NO: 46927
  Payload ID: 9491
  Gene Symbol: LAT
  Gene Name: linker for activation of T cells
  ENSP ID: ENSP00000488120

SEQ ID NO: 46932 - protein, 243 aa, Homo sapiens
  Payload ID: 9492
  Gene Symbol: LAT2
  Gene Name: linker for activation of T cells family, member 2
  Uniprot ID: Q9GZY6
  ENSP ID: ENSP00000275635
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYIDPIAMEYYNWGRFSKPPEDDDANSYENVLICKQKTTETGAQQEGIGGLCRGDLSLSLALKTGPTSGLCPSASPEEDEESEDYQNSASIHQWRESRKVMGQLQREASPGPVGSPDEEDGEPDYVNGEVAATEA

SEQ ID NO: 46933 - protein, 243 aa, Homo sapiens; identical to SEQ ID NO: 46932
  Payload ID: 9492
  Gene Symbol: LAT2
  Gene Name: linker for activation of T cells family, member 2
  Uniprot ID: Q9GZY6
  ENSP ID: ENSP00000344881

SEQ ID NO: 46934 - protein, 63 aa, Homo sapiens
  Payload ID: 9492
  Gene Symbol: LAT2
  Gene Name: linker for activation of T cells family, member 2
  ENSP ID: ENSP00000354374
MSSGTELLWPGAALLVLLGVAASLCVRCSRPGAKRSEKIYQQRSLREDQQSFTGSRTYSLVGQ

SEQ ID NO: 46935 - protein, 243 aa, Homo sapiens; identical to SEQ ID NO: 46932
  Payload ID: 9492
  Gene Symbol: LAT2
  Gene Name: linker for activation of T cells family, member 2
  Uniprot ID: Q9GZY6
  ENSP ID: ENSP00000381492

SEQ ID NO: 46936 - protein, 100 aa, Homo sapiens
  Payload ID: 9492
  Gene Symbol: LAT2
  Gene Name: linker for activation of T cells family, member 2
  ENSP ID: ENSP00000417533
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSK

SEQ ID NO: 46937 - protein, 100 aa, Homo sapiens
  Payload ID: 9492
  Gene Symbol: LAT2
  Gene Name: linker for activation of T cells family, member 2
  ENSP ID: ENSP00000419150
MSSGTELLWPGAALLVLLGVAASLCVRCSRPGAKRREDQQSFTGSRTYSLVGQAWPGPLADMAPTRKDKLLQFYPSLEDPASSRYQNFSKGSRHGSEEAY

SEQ ID NO: 46938 - protein, 243 aa, Homo sapiens; identical to SEQ ID NO: 46932
  Payload ID: 9492
  Gene Symbol: LAT2
  Gene Name: linker for activation of T cells family, member 2
  Uniprot ID: Q9GZY6
  ENSP ID: ENSP00000420494

SEQ ID NO: 46939 - protein, 58 aa, Homo sapiens
  Payload ID: 9492
  Gene Symbol: LAT2
  Gene Name: linker for activation of T cells family, member 2
  ENSP ID: ENSP00000420549
MSSGTELLWPGAALLVLLGVAASLCVRCSRPGAKRSEKIYQQRSLREDQQSFTGSRTY

SEQ ID NO: 46940 - protein, 111 aa, Homo sapiens
  Payload ID: 9492
  Gene Symbol: LAT2
  Gene Name: linker for activation of T cells family, member 2
  Uniprot ID: Q9GZY6
  ENSP ID: ENSP00000433807
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYI

SEQ ID NO: 46941 - protein, 219 aa, Homo sapiens
  Payload ID: 9493
  Gene Symbol: LIPA
  Gene Name: lipase A, lysosomal acid, cholesterol esterase
  ENSP ID: ENSP00000282673
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRL

SEQ ID NO: 46942 - protein, 399 aa, Homo sapiens
  Payload ID: 9493
  Gene Symbol: LIPA
  Gene Name: lipase A, lysosomal acid, cholesterol esterase
  Uniprot ID: P38571
  ENSP ID: ENSP00000337354
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 46943 - protein, 343 aa, Homo sapiens
  Payload ID: 9493
  Gene Symbol: LIPA
  Gene Name: lipase A, lysosomal acid, cholesterol esterase
  Uniprot ID: P38571
  ENSP ID: ENSP00000360903
MACLEFVPFDVQMCLEFLPSGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 46944 - protein, 290 aa, Homo sapiens
  Payload ID: 9493
  Gene Symbol: LIPA
  Gene Name: lipase A, lysosomal acid, cholesterol esterase
  ENSP ID: ENSP00000388415
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSV

SEQ ID NO: 46945 - protein, 283 aa, Homo sapiens
  Payload ID: 9493
  Gene Symbol: LIPA
  Gene Name: lipase A, lysosomal acid, cholesterol esterase
  ENSP ID: ENSP00000413019
MGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 46946 - protein, 567 aa, Homo sapiens
  Payload ID: 9494
  Gene Symbol: LMF1
  Gene Name: lipase maturation factor 1
  Uniprot ID: Q96S06
  ENSP ID: ENSP00000262301
MRPDSPTMAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFGWESQLLETGFLGIFLCPLWTLSRLPQHTPTSRIVLWGFRWLIFRIMLGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRWVRGEHYRYKFSRPGGRHAAEGKWWVRKRIGAYFPPLSLEELRPYFRDRGWPLPGPL

SEQ ID NO: 46947 - protein, 330 aa, Homo sapiens
  Payload ID: 9494
  Gene Symbol: LMF1
  Gene Name: lipase maturation factor 1
  Uniprot ID: Q96S06
  ENSP ID: ENSP00000437418
MDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRWVRGEHYRYKFSRPGGRHAAEGKWWVRKRIGAYFPPLSLEELRPYFRDRGWPLPGPL

SEQ ID NO: 46948 - protein, 95 aa, Homo sapiens
  Payload ID: 9494
  Gene Symbol: LMF1
  Gene Name: lipase maturation factor 1
  ENSP ID: ENSP00000443820
MPTILWLMDWSDMNSNLDLLALLGLGISSFVLITGCANMLLMAALWGLYMSLVNVGHVWYSFAAQHVTLDCRAEIQKTRSSFGSALPAFRAAMRL

SEQ ID NO: 46949 - protein, 198 aa, Homo sapiens
  Payload ID: 9494
  Gene Symbol: LMF1
  Gene Name: lipase maturation factor 1
  ENSP ID: ENSP00000454672
MPTILWLMDWSDMNSNLDLLALLGLGISSFVLITGCANMLLMAALWGLYMSLVNVGHVWYSFGWESQLLETGFLGIFLCPLWTLSRLPQHTPTSRIVLWGFRWLIFRIMLGAGLIKIRGDRCWRDLTCMDFHYETQPMPNPVAYYLHHSPWWFHRFETLSNHFIELLVPFFLFLGRRACIIHGVLQILFQAVLIVSGN

SEQ ID NO: 46950 - protein, 150 aa, Homo sapiens
  Payload ID: 9494
  Gene Symbol: LMF1
  Gene Name: lipase maturation factor 1
  ENSP ID: ENSP00000455162
MYSFGWESQLLETGFLGIFLCPLWTLSRLPQHTPTSRIVLWGFRWLIFRIMLGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMV

SEQ ID NO: 46951 - protein, 134 aa, Homo sapiens
  Payload ID: 9494
  Gene Symbol: LMF1
  Gene Name: lipase maturation factor 1
  ENSP ID: ENSP00000455715
IYRPCLLLAARATRYFLGISSLQLPVVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFGK

SEQ ID NO: 46952 - protein, 184 aa, Homo sapiens
  Payload ID: 9494
  Gene Symbol: LMF1
  Gene Name: lipase maturation factor 1
  ENSP ID: ENSP00000455833
MRPDSPTMAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFASAISLPSMHGGQ

SEQ ID NO: 46953 - protein, 149 aa, Homo sapiens
  Payload ID: 9494
  Gene Symbol: LMF1
  Gene Name: lipase maturation factor 1
  ENSP ID: ENSP00000455930
PSRAGPRPGASGTLLHPEGLCLPGFPGVIQTWGEKNHHPSHTQTQRDSKPGGAGWTQRPSPCQPKGHGPRSPPPAPRAQLCAGHQKPQIMTAAQTVATGPWCSVKPLAPAWAHSRGHERVLLWLHHHTHRAAGAQLCHGSQPGSSRPVG

SEQ ID NO: 46954 - protein, 168 aa, Homo sapiens
  Payload ID: 9494
  Gene Symbol: LMF1
  Gene Name: lipase maturation factor 1
  ENSP ID: ENSP00000456631
  MOD_RES (1)..(1): Any amino acid
XTMAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFGK

SEQ ID NO: 46955 - protein, 161 aa, Homo sapiens
  Payload ID: 9494
  Gene Symbol: LMF1
  Gene Name: lipase maturation factor 1
  ENSP ID: ENSP00000457725
  MOD_RES (1)..(1): Any amino acid
XPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFASAISLPSMHGGQ

SEQ ID NO: 46956 - protein, 350 aa, Homo sapiens
  Payload ID: 9494
  Gene Symbol: LMF1
  Gene Name: lipase maturation factor 1
  ENSP ID: ENSP00000458135
MLGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRWVRGEHYRYKFSRPGGRHAAEGKWWVRKRIGAYFPPLSLEELRPYFRDRGWPLPGPL

SEQ ID NO: 46957 - protein, 682 aa, Homo sapiens
  Payload ID: 9495
  Gene Symbol: LMF2
  Gene Name: lipase maturation factor 2
  Uniprot ID: Q9BU23
  ENSP ID: ENSP00000216080
MTCPPTGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 46958 - protein, 707 aa, Homo sapiens
  Payload ID: 9495
  Gene Symbol: LMF2
  Gene Name: lipase maturation factor 2
  Uniprot ID: Q9BU23
  ENSP ID: ENSP00000424381
MAGSRLPRQLFLQGVAAVFMFAFASLYTQIPGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 46959 - protein, 500 aa, Homo sapiens
  Payload ID: 9496
  Gene Symbol: LIPG
  Gene Name: lipase, endothelial
  Uniprot ID: Q9Y5X9
  ENSP ID: ENSP00000261292
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 46960 - protein, 426 aa, Homo sapiens
  Payload ID: 9496
  Gene Symbol: LIPG
  Gene Name: lipase, endothelial
  ENSP ID: ENSP00000387978
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITAITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 46961 - protein, 354 aa, Homo sapiens
  Payload ID: 9496
  Gene Symbol: LIPG
  Gene Name: lipase, endothelial
  Uniprot ID: Q9Y5X9
  ENSP ID: ENSP00000462420
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRGNLQSLECP

SEQ ID NO: 46962 - protein, 188 aa, Homo sapiens
  Payload ID: 9496
  Gene Symbol: LIPG
  Gene Name: lipase, endothelial
  ENSP ID: ENSP00000462480
LCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQVLGDERESPVTSRISNPIFLRNAGHASVAMNFWSLIKIFEIKSFIEL

SEQ ID NO: 46963 - protein, 24 aa, Homo sapiens
  Payload ID: 9496
  Gene Symbol: LIPG
  Gene Name: lipase, endothelial
  ENSP ID: ENSP00000463077
MTAKTFFIIHGWTMSGIFENWLHK

SEQ ID NO: 46964 - protein, 390 aa, Homo sapiens
  Payload ID: 9496
  Gene Symbol: LIPG
  Gene Name: lipase, endothelial
  ENSP ID: ENSP00000463835
MLSFSRDRLPSGRRVSGKCPPPPLGMAVGRGGSGCPEEGSGRKLELLESQLPAERAREEAGPSVRRPRDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRGNLQSLECP

SEQ ID NO: 46965 - protein, 366 aa, Homo sapiens
  Payload ID: 9497
  Gene Symbol: LIPJ
  Gene Name: lipase, family member J
  Uniprot ID: Q5W064
  ENSP ID: ENSP00000361007
MNISQIISYWGYPDEEYDIVTEDGYILGLYRIPYWRTDNNKNLAQRVVVYLQHGLLTSASSWISNLPNNSLGFILADAGYDVWMGNSRGNTWSRKHLYLETSSKEFWAFSFDEMAKYDLPASIDFTVKQTRQEEIFYVGHSQGTTIGFITFSTISKIAERIKIFFALAPVFSTKYLKSPLIRMTYKWKSIVMAFSGNKDFLPKTSFKKFIGSKLCPLQIFDKICLNILFMMFGYDPKNLNMSRLDVYFSHNPAGTSVQNMLHWSQLLNSTHLKAYDWGSPDLNLVHYNQTTSPLYNMTNMNVATAIWNGKSDLLADPEDVNILHSEITNHIYYKTISYYNHIDSLFGLDVYDQVYHEIIDIIQDNL

SEQ ID NO: 46966 - protein, 154 aa, Homo sapiens
  Payload ID: 9497
  Gene Symbol: LIPJ
  Gene Name: lipase, family member J
  ENSP ID: ENSP00000434211
YVGHSQGTTIGFITFSTISKIAERIKIFFALAPVFSTKYLKSPLIRMTYKWKSIVMSRLDVYFSHNPAGTSVQNMLHWSQLLNSTHLKAYDWGSPDLNLVHYNQTTSPLYNMTNMNVATAIWNGKSDLLADPEDVNILHSEITNHIYYKTISYY

SEQ ID NO: 46967 - protein, 399 aa, Homo sapiens
  Payload ID: 9498
  Gene Symbol: LIPK
  Gene Name: lipase, family member K
  Uniprot ID: Q5VXJ0
  ENSP ID: ENSP00000383900
MWQLLAAACWMLLLGSMYGYDKKGNNANPEANMNISQIISYWGYPYEEYDVTTKDGYILGIYRIPHGRGCPGRTAPKPAVYLQHGLIASASNWICNLPNNSLAFLLADSGYDVWLGNSRGNTWSRKHLKLSPKSPEYWAFSLDEMAKYDLPATINFIIEKTGQKRLYYVGHSQGTTIAFIAFSTNPELAKKIKIFFALAPVVTVKYTQSPMKKLTTLSRRVVKVLFGDKMFHPHTLFDQFIATKVCNRKLFRRICSNFLFTLSGFDPQNLNMSRLDVYLSHNPAGTSVQNMLHWAQAVNSGQLQAFDWGNSDQNMMHFHQLTPPLYNITKMEVPTAIWNGGQDIVADPKDVENLLPQIANLIYYKLIPHYNHVDFYLGEDAPQEIYQDLIILMEEYLQN

SEQ ID NO: 46968 - protein, 423 aa, Homo sapiens
  Payload ID: 9499
  Gene Symbol: LIPM
  Gene Name: lipase, family member M
  Uniprot ID: Q5VYY2
  ENSP ID: ENSP00000383901
MLETLSRQWIVSHRMEMWLLILVAYMFQRNVNSVHMPTKAVDPEAFMNISEIIQHQGYPCEEYEVATEDGYILSVNRIPRGLVQPKKTGSRPVVLLQHGLVGGASNWISNLPNNSLGFILADAGFDVWMGNSRGNAWSRKHKTLSIDQDEFWAFSYDEMARFDLPAVINFILQKTGQEKIYYVGYSQGTTMGFIAFSTMPELAQKIKMYFALAPIATVKHAKSPGTKFLLLPDMMIKGLFGKKEFLYQTRFLRQLVIYLCGQVILDQICSNIMLLLGGFNTNNMNMSRASVYAAHTLAGTSVQNILHWSQAVNSGELRAFDWGSETKNLEKCNQPTPVRYRVRDMTVPTAMWTGGQDWLSNPEDVKMLLSEVTNLIYHKNIPEWAHVDFIWGLDAPHRMYNEIIHLMQQEETNLSQGRCEAVL

SEQ ID NO: 46969 - protein, 383 aa, Homo sapiens
  Payload ID: 9499
  Gene Symbol: LIPM
  Gene Name: lipase, family member M
  Uniprot ID: Q5VYY2
  ENSP ID: ENSP00000440375
MTRPLDRKQSEIIQHQGYPCEEYEVATEDGYILSVNRIPRGLVQPKKTGSRPVVLLQHGLVGGASNWISNLPNNSLGFILADAGFDVWMGNSRGNAWSRKHKTLSIDQDEFWAFSYDEMARFDLPAVINFILQKTGQEKIYYVGYSQGTTMGFIAFSTMPELAQKIKMYFALAPIATVKHAKSPGTKFLLLPDMMIKGLFGKKEFLYQTRFLRQLVIYLCGQVILDQICSNIMLLLGGFNTNNMNMSRASVYAAHTLAGTSVQNILHWSQAVNSGELRAFDWGSETKNLEKCNQPTPVRYRVRDMTVPTAMWTGGQDWLSNPEDVKMLLSEVTNLIYHKNIPEWAHVDFIWGLDAPHRMYNEIIHLMQQEETNLSQGRCEAVL

SEQ ID NO: 46970 - protein, 398 aa, Homo sapiens
  Payload ID: 9500
  Gene Symbol: LIPN
  Gene Name: lipase, family member N
  Uniprot ID: Q5VXI9
  ENSP ID: ENSP00000383923
MMWLLLTTTCLICGTLNAGGFLDLENEVNPEVWMNTSEIIIYNGYPSEEYEVTTEDGYILLVNRIPYGRTHARSTGPRPVVYMQHALFADNAYWLENYANGSLGFLLADAGYDVWMGNSRGNTWSRRHKTLSETDEKFWAFSFDEMAKYDLPGVIDFIVNKTGQEKLYFIGHSLGTTIGFVAFSTMPELAQRIKMNFALGPTISFKYPTGIFTRFFLLPNSIIKAVFGTKGFFLEDKKTKIASTKICNNKILWLICSEFMSLWAGSNKKNMNQSRMDVYMSHAPTGSSVHNILHIKQLYHSDEFRAYDWGNDADNMKHYNQSHPPIYDLTAMKVPTAIWAGGHDVLVTPQDVARILPQIKSLHYFKLLPDWNHFDFVWGLDAPQRMYSEIIALMKAYS

SEQ ID NO: 46971 - protein, 398 aa, Homo sapiens
  Payload ID: 9501
  Gene Symbol: LIPF
  Gene Name: lipase, gastric
  Uniprot ID: P07098
  ENSP ID: ENSP00000238983
MWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 46972 - protein, 375 aa, Homo sapiens
  Payload ID: 9501
  Gene Symbol: LIPF
  Gene Name: lipase, gastric
  Uniprot ID: P07098
  ENSP ID: ENSP00000348101
MFSNANSRSKMWLLLTMASLISVLGTTHGLFGKLHPGSPEVTMNISQMITYWGYPNEEYEVVTEDGYILEVNRIPYGKKNSGNTDAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 46973 - protein, 408 aa, Homo sapiens
  Payload ID: 9501
  Gene Symbol: LIPF
  Gene Name: lipase, gastric
  Uniprot ID: P07098
  ENSP ID: ENSP00000377900
MFSNANSRSKMWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 46974 - protein, 365 aa, Homo sapiens
  Payload ID: 9501
  Gene Symbol: LIPF
  Gene Name: lipase, gastric
  Uniprot ID: P07098
  ENSP ID: ENSP00000477140
MWLLLTMASLISVLGTTHGLFGKLHPGSPEVTMNISQMITYWGYPNEEYEVVTEDGYILEVNRIPYGKKNSGNTDAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 46975 - protein, 499 aa, Homo sapiens
  Payload ID: 9502
  Gene Symbol: LIPC
  Gene Name: lipase, hepatic
  Uniprot ID: P11150
  ENSP ID: ENSP00000299022
MDTSPLCFSILLVLCIFIQSSALGQSLKPEPFGRRAQAVETNKTLHEMKTRFLLFGETNQGCQIRINHPDTLQECGFNSSLPLVMIIHGWSVDGVLENWIWQMVAALKSQPAQPVNVGLVDWITLAHDHYTIAVRNTRLVGKEVAALLRWLEESVQLSRSHVHLIGYSLGAHVSGFAGSSIGGTHKIGRITGLDAAGPLFEGSAPSNRLSPDDANFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQFKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRMTFCSENTDDLLLRPTQEKIFVKCEIKSKTSKRKIR

SEQ ID NO: 46976 - protein, 499 aa, Homo sapiens; identical to SEQ ID NO: 46975
  Payload ID: 9502
  Gene Symbol: LIPC
  Gene Name: lipase, hepatic
  Uniprot ID: P11150
  ENSP ID: ENSP00000348425

SEQ ID NO: 46977 - protein, 438 aa, Homo sapiens
  Payload ID: 9502
  Gene Symbol: LIPC
  Gene Name: lipase, hepatic
  ENSP ID: ENSP00000395002
MDTSPLCFSILLVLCIFIQSSALGQSLKPEPFGRRAQAVETNKTLHEMKTRFLLFGETNQGCQIRINHPDTLQECGFNSSLPLVMIIHGWSESVQLSRSHVHLIGYSLGAHVSGFAGSSIGGTHKIGRITGLDAAGPLFEGSAPSNRLSPDDANFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQFKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRMTFCSENTDDLLLRPTQEKIFVKCEIKSKTSKRKIR

SEQ ID NO: 46978 - protein, 499 aa, Homo sapiens
  Payload ID: 9502
  Gene Symbol: LIPC
  Gene Name: lipase, hepatic
  ENSP ID: ENSP00000395569
MDTSPLCFSILLVLCIFIQSSALGQSLKPEPFGRRAQAVETNKTLHEMKTRFLLFGETNQGCQIRINHPDTLQECGFNSSLPLVMIIHGWSVDGVLENWIWQMVAALKSQPAQPVNVGLVDWITLAHDHYTIAVRNTRLVGKEVAALLRWLEESVQLSRSHVHLIGYSLGAHVSGFAGSSIGGTHKIGRITGLDAAGPLFEGSAPSNRLSPDDANFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQFKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRSPNRINLGRLNCSLLFCTELFSHDSLAHWSSAASEL

SEQ ID NO: 46979 - protein, 1076 aa, Homo sapiens
  Payload ID: 9503
  Gene Symbol: LIPE
  Gene Name: lipase, hormone-sensitive
  Uniprot ID: Q05469
  ENSP ID: ENSP00000244289
MEPGSKSVSRSDWQPEPHQRPITPLEPGPEKTPIAQPESKTLQGSNTQQKPASNQRPLTQQETPAQHDAESQKEPRAQQKSASQEEFLAPQKPAPQQSPYIQRVLLTQQEAASQQGPGLGKESITQQEPALRQRHVAQPGPGPGEPPPAQQEAESTPAAQAKPGAKREPSAPTESTSQETPEQSDKQTTPVQGAKSKQGSLTELGFLTKLQELSIQRSALEWKALSEWVTDSESESDVGSSSDTDSPATMGGMVAQGVKLGFKGKSGYKVMSGYSGTSPHEKTSARNHRHYQDTASRLIHNMDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSVAASSLFTSGRFAIDPELRGAEFERITQNLDVHFWKAFWNITEMEVLSSLANMASATVRVSRLLSLPPEAFEMPLTADPTLTVTISPPLAHTGPGPVLVRLISYDLREGQDSEELSSLIKSNGQRSLELWPRPQQAPRSRSLIVHFHGGGFVAQTSRSHEPYLKSWAQELGAPIISIDYSLAPEAPFPRALEECFFAYCWAIKHCALLGSTGERICLAGDSAGGNLCFTVALRAAAYGVRVPDGIMAAYPATMLQPAASPSRLLSLMDPLLPLSVLSKCVSAYAGAKTEDHSNSDQKALGMMGLVRRDTALLLRDFRLGASSWLNSFLELSGRKSQKMSEPIAEPMRRSVSEAALAQPQGPLGTDSLKNLTLRDLSLRGNSETSSDTPEMSLSAETLSPSTPSDVNFLLPPEDAGEEAEAKNELSPMDRGLGVRAAFPEGFHPRRSSQGATQMPLYSSPIVKNPFMSPLLAPDSMLKSLPPVHIVACALDPMLDDSVMLARRLRNLGQPVTLRVVEDLPHGFLTLAALCRETRQAAELCVERIRLVLTPPAGAGPSGETGAAGVDGGCGGRH

SEQ ID NO: 46980 - protein, 80 aa, Homo sapiens
  Payload ID: 9503
  Gene Symbol: LIPE
  Gene Name: lipase, hormone-sensitive
  ENSP ID: ENSP00000469030
MDLRTMTQSLVTLAEDNIAFFSSQGPGETAQRLSGVFAGVREQALGLEPALGRLLGVAHLFDLDPETPANGYRSLVHTAR

SEQ ID NO: 46981 - protein, 176 aa, Homo sapiens
  Payload ID: 9503
  Gene Symbol: LIPE
  Gene Name: lipase, hormone-sensitive
  ENSP ID: ENSP00000469268
MDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPA

SEQ ID NO: 46982 - protein, 305 aa, Homo sapiens
  Payload ID: 9503
  Gene Symbol: LIPE
  Gene Name: lipase, hormone-sensitive
  ENSP ID: ENSP00000469545
  MOD_RES (1)..(1): Any amino acid
XEECFFAYCWAIKHCALLGAKTEDHSNSDQKALGMMGLVRRDTALLLRDFRLGASSWLNSFLELSGRKSQKMSEPIAEPMRRSVSEAALAQPQGPLGTDSLKNLTLRDLSLRGNSETSSDTPEMSLSAETLSPSTPSDVNFLLPPEDAGEEAEAKNELSPMDRGLGVRAAFPEGFHPRRSSQGATQMPLYSSPIVKNPFMSPLLAPDSMLKSLPPVHIVACALDPMLDDSVMLARRLRNLGQPVTLRVVEDLPHGFLTLAALCRETRQAAELCVERIRLVLTPPAGAGPSGETGAAGVDGGCGGR

SEQ ID NO: 46983 - protein, 260 aa, Homo sapiens
  Payload ID: 9503
  Gene Symbol: LIPE
  Gene Name: lipase, hormone-sensitive
  ENSP ID: ENSP00000469990
MELAGGTEPAEAAMAPASKNAKEGSRSHGRRRWRKDKAKASRLIHNMDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSVAASSLFTSGR

SEQ ID NO: 46984 - protein, 275 aa, Homo sapiens
  Payload ID: 9503
  Gene Symbol: LIPE
  Gene Name: lipase, hormone-sensitive
  ENSP ID: ENSP00000472218
  MOD_RES (1)..(1): Any amino acid
XRAAAYGVRVPDGIMAAYPATMLQPAASPSRLLSLMDPLLPLSVLSKCVSAYAGAKTEDHSNSDQKALGMMGLVRRDTALLLRDFRLGASSWLNSFLELSGRKSQKMSEPIAGLSALPLSEPMRRSVSEAALAQPQGPLGTDSLKNLTLRDLSLRGNSETSSDTPEMSLSAETLSPSTPSDVNFLLPPEDAGEEAEAKNELSPMDRGLGVRAAFPEGFHPRRSSQGATQMPLYSSPIVKNPFMSPLLAPDSMLKSLPPVHIVACALDPMLDDSVM

SEQ ID NO: 46985 - protein, 222 aa, Homo sapiens
  Payload ID: 9503
  Gene Symbol: LIPE
  Gene Name: lipase, hormone-sensitive
  ENSP ID: ENSP00000472531
MPRRASRLIHNMDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSVAASSLFT

SEQ ID NO: 46986 - protein, 451 aa, Homo sapiens
  Payload ID: 9504
  Gene Symbol: LIPH
  Gene Name: lipase, member H
  Uniprot ID: Q8WWY8
  ENSP ID: ENSP00000296252
MLRFYLFISLLCLSRSDAEETCPSFTRLSFHSAVVGTGLNVRLMLYTRKNLTCAQTINSSAFGNLNVTKKTTFIVHGFRPTGSPPVWMDDLVKGLLSVEDMNVVVVDWNRGATTLIYTHASSKTRKVAMVLKEFIDQMLAEGASLDDIYMIGVSLGAHISGFVGEMYDGWLGRITGLDPAGPLFNGKPHQDRLDPSDAQFVDVIHSDTDALGYKEPLGNIDFYPNGGLDQPGCPKTILGGFQYFKCDHQRSVYLYLSSLRESCTITAYPCDSYQDYRNGKCVSCGTSQKESCPLLGYYADNWKDHLRGKDPPMTKAFFDTAEESPFCMYHYFVDIITWNKNVRRGDITIKLRDKAGNTTESKINHEPTTFQKYHQVSLLARFNQDLDKVAAISLMFSTGSLIGPRYKLRILRMKLRSLAHPERPQLCRYDLVLMENVETVFQPILCPELQL

SEQ ID NO: 46987 - protein, 73 aa, Homo sapiens
  Payload ID: 9504
  Gene Symbol: LIPH
  Gene Name: lipase, member H
  ENSP ID: ENSP00000390228
  MOD_RES (1)..(1): Any amino acid
XSPFCMYHYFVDIITWNKNVRRGDITIKLRDKAGNTTESKINQISNRPKVQAQDSPNEVKVPCPSGEASAVSV

SEQ ID NO: 46988 - protein, 417 aa, Homo sapiens
  Payload ID: 9504
  Gene Symbol: LIPH
  Gene Name: lipase, member H
  ENSP ID: ENSP00000396384
MLRFYLFISLLCLSRSDAEETCPSFTRLSFHSAVVGTGLNVRLMLYTRKNLTCAQTINSSAFGNLNVTKKTTFIVHGFRPTGSPPVWMDDLVKGLLSVEDMNVVVVDWNRGATTLIYTHASSKTRKVAMVLKEFIDQMLAEGASLDDIYMIGVSLGAHISGFVGEMYDGWLGRITALGYKEPLGNIDFYPNGGLDQPGCPKTILGGFQYFKCDHQRSVYLYLSSLRESCTITAYPCDSYQDYRNGKCVSCGTSQKESCPLLGYYADNWKDHLRGKDPPMTKAFFDTAEESPFCMYHYFVDIITWNKNVRRGDITIKLRDKAGNTTESKINHEPTTFQKYHQVSLLARFNQDLDKVAAISLMFSTGSLIGPRYKLRILRMKLRSLAHPERPQLCRYDLVLMENVETVFQPILCPELQL

SEQ ID NO: 46989 - protein, 85 aa, Homo sapiens
  Payload ID: 9504
  Gene Symbol: LIPH
  Gene Name: lipase, member H
  ENSP ID: ENSP00000408218
  MOD_RES (1)..(1): Any amino acid
XDIYMIGVSLGAHISGFVGEMYDGWLGRITGFQYFKCDHQRSVYLYLSSLRESCTITAYPCDSYQDYRNGKCVSCGTSQKESCPL

SEQ ID NO: 46990 - protein, 47 aa, Homo sapiens
  Payload ID: 9504
  Gene Symbol: LIPH
  Gene Name: lipase, member H
  ENSP ID: ENSP00000414311
MLRFYLFISLLCLSRSDASLDMNEESPLFEEGFLQSEIWEIKLIPPK

SEQ ID NO: 46991 - protein, 481 aa, Homo sapiens
  Payload ID: 9505
  Gene Symbol: LIPI
  Gene Name: lipase, member I
  Uniprot ID: Q6XZB0
  ENSP ID: ENSP00000343331
MLLKCLHNNLCQKYSAHAFQFSPRNVLWLLVVCLRSDNKRPCLEFSQLSVKDSFRDLFIPRIETILMMYTRNNLNCAEPLFEQNNSLNVNFNTQKKTVWLIHGYRPVGSIPLWLQNFVRILLNEEDMNVIVVDWSRGATTFIYNRAVKNTRKVAVSLSVHIKNLLKHGASLDNFHFIGVSLGAHISGFVGKIFHGQLGRITGLDPAGPRFSRKPPYSRLDYTDAKFVDVIHSDSNGLGIQEPLGHIDFYPNGGNKQPGCPKSIFSGIQFIKCNHQRAVHLFMASLETNCNFISFPCRSYKDYKTSLCVDCDCFKEKSCPRLGYQAKLFKGVLKERMEGRPLRTTVFLDTSGTYPFCTYYFVLSIIVPDKTMMDGSFSFKLLNQLGMIEEPRLYEKNKPFYKLQEVKILAQFYNDFVNISSIGLTYFQSSNLQCSTCTYKIQSLMLKSLTYPERPPLCRYNIVLKDREEVFLNPNTCTPKNT

SEQ ID NO: 46992 - protein, 141 aa, Homo sapiens
  Payload ID: 9505
  Gene Symbol: LIPI
  Gene Name: lipase, member I
  ENSP ID: ENSP00000383072
  MOD_RES (1)..(1): Any amino acid
XYNRAVKNTRKVAVSLSVHIKNLLKHGASLDNFHFIGVSLGAHISGFVGKIFHGQLGRITGLDPAGPRFSRKPPYSRLDYTDAKFVDVIHSDSNGIQFIKCNHQRAVHLFMASLETNCNFISFPCRSYKDYKTSLCVDCDC

SEQ ID NO: 46993 - protein, 451 aa, Homo sapiens
  Payload ID: 9505
  Gene Symbol: LIPI
  Gene Name: lipase, member I
  Uniprot ID: Q6XZB0
  ENSP ID: ENSP00000440381
MCWVRSDNKRPCLEFSQLSVKDSFRDLFIPRIETILMMYTRNNLNCAEPLFEQNNSLNVNFNTQKKTVWLIHGYRPVGSIPLWLQNFVRILLNEEDMNVIVVDWSRGATTFIYNRAVKNTRKVAVSLSVHIKNLLKHGASLDNFHFIGVSLGAHISGFVGKIFHGQLGRITGLDPAGPRFSRKPPYSRLDYTDAKFVDVIHSDSNGLGIQEPLGHIDFYPNGGNKQPGCPKSIFSGIQFIKCNHQRAVHLFMASLETNCNFISFPCRSYKDYKTSLCVDCDCFKEKSCPRLGYQAKLFKGVLKERMEGRPLRTTVFLDTSGTYPFCTYYFVLSIIVPDKTMMDGSFSFKLLNQLGMIEEPRLYEKNKPFYKLQEVKILAQFYNDFVNISSIGLTYFQSSNLQCSTCTYKIQSLMLKSLTYPERPPLCRYNIVLKDREEVFLNPNTCTPKNT

SEQ ID NO: 46994 - protein, 421 aa, Homo sapiens
  Payload ID: 9505
  Gene Symbol: LIPI
  Gene Name: lipase, member I
  ENSP ID: ENSP00000482652
MCWVRSDNKRPCLEFSQLSVKDSFRDLFIPRIETILMMYTRNNLNCAEPLFEQNNSLNVNFNTQKKTVWLIHGYRPVGSIPLWLQNFVRILLNEEDMNVIVVDWSRGATTFIYNRAVKNTRKVAVSLSVHIKNLLKHGASLDNFHFIGVSLGAHISGFVGKIFHGQLGRITGLDPAGPRFSRKPPYSRLDYTDAKFVDVIHSDSNGIQFIKCNHQRAVHLFMASLETNCNFISFPCRSYKDYKTSLCVDCDCFKEKSCPRLGYQAKLFKGVLKERMEGRPLRTTVFLDTSGTYPFCTYYFVLSIIVPDKTMMDGSFSFKLLNQLGMIEEPRLYEKNKPFYKLQEVKILAQFYNDFVNISSIGLTYFQSSNLQCSTCTYKIQSLMLKSLTYPERPPLCRYNIVLKDREEVFLNPNTCTPKNT

SEQ ID NO: 46995 - protein, 325 aa, Homo sapiens
  Payload ID: 9506
  Gene Symbol: LDAH
  Gene Name: lipid droplet associated hydrolase
  Uniprot ID: Q9H6V9
  ENSP ID: ENSP00000237822
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 46996 - protein, 370 aa, Homo sapiens
  Payload ID: 9506
  Gene Symbol: LDAH
  Gene Name: lipid droplet associated hydrolase
  ENSP ID: ENSP00000370480
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKIGNPSWHYHSLRTMRCPSAQILKPPDERFGSDLLPTYWWKNQISRD

SEQ ID NO: 46997 - protein, 240 aa, Homo sapiens
  Payload ID: 9506
  Gene Symbol: LDAH
  Gene Name: lipid droplet associated hydrolase
  ENSP ID: ENSP00000384267
MKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKIGNPSWHYHSLRTMRCPSAQILKPPDERFGSDLLPTYWWKNQISRD

SEQ ID NO: 46998 - protein, 146 aa, Homo sapiens
  Payload ID: 9506
  Gene Symbol: LDAH
  Gene Name: lipid droplet associated hydrolase
  ENSP ID: ENSP00000385951
MDSELKEEIPVHEEFILCGGAETQVLKCGPWTDLFHDQSVKRPKLLIFIIPGERKSLGNPGFSAFYVPFAKALYSLTNRRFPVWTISHAGHALAPKDKKILTTSEDSNAQEIKDIYGLNGQIEHKLAFLRTHVPKDMKLVLIGHSI

SEQ ID NO: 46999 - protein, 283 aa, Homo sapiens
  Payload ID: 9506
  Gene Symbol: LDAH
  Gene Name: lipid droplet associated hydrolase
  ENSP ID: ENSP00000388635
MDSELKEEIPVHEEFILCGGAETQVLKCGPWTDLFHDQSVKRPKLLIFIIPGERKSLDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 47000 - protein, 130 aa, Homo sapiens
  Payload ID: 9506
  Gene Symbol: LDAH
  Gene Name: lipid droplet associated hydrolase
  ENSP ID: ENSP00000396911
MKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHL

SEQ ID NO: 47001 - protein, 166 aa, Homo sapiens
  Payload ID: 9506
  Gene Symbol: LDAH
  Gene Name: lipid droplet associated hydrolase
  ENSP ID: ENSP00000400340
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPLMLPTLGAKK

SEQ ID NO: 47002 - protein, 159 aa, Homo sapiens
  Payload ID: 9506
  Gene Symbol: LDAH
  Gene Name: lipid droplet associated hydrolase
  ENSP ID: ENSP00000400910
MDSELKEEIPVHEEFILCGGAETQVLKCGPWTDLFHDQSVKRPKLLIFIIPDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKS

SEQ ID NO: 47003 - protein, 156 aa, Homo sapiens
  Payload ID: 9506
  Gene Symbol: LDAH
  Gene Name: lipid droplet associated hydrolase
  ENSP ID: ENSP00000414710
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEGGILAVLSWWTQEASPLGTLAGSTLMTPSDPNYFPKTPLHLLIAFGHRVSPMDLGAI

SEQ ID NO: 47004 - protein, 195 aa, Homo sapiens
  Payload ID: 9506
  Gene Symbol: LDAH
  Gene Name: lipid droplet associated hydrolase
  Uniprot ID: Q9H6V9
  ENSP ID: ENSP00000440570
MKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 47005 - protein, 195 aa, Homo sapiens; identical to SEQ ID NO: 47004
  Payload ID: 9506
  Gene Symbol: LDAH
  Gene Name: lipid droplet associated hydrolase
  Uniprot ID: Q9H6V9
  ENSP ID: ENSP00000483067

SEQ ID NO: 47006 - protein, 277 aa, Homo sapiens
  Payload ID: 9506
  Gene Symbol: LDAH
  Gene Name: lipid droplet associated hydrolase
  Uniprot ID: Q9H6V9
  ENSP ID: ENSP00000487592
MDSELKEEIPVHEEFILCGGAETQVLKCGPWTDLFHDQSVKRPKLLIFIIPDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 47007 - protein, 890 aa, Homo sapiens
  Payload ID: 9507
  Gene Symbol: LPIN1
  Gene Name: lipin 1
  Uniprot ID: Q14693
  ENSP ID: ENSP00000256720
MNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 47008 - protein, 932 aa, Homo sapiens
  Payload ID: 9507
  Gene Symbol: LPIN1
  Gene Name: lipin 1
  Uniprot ID: Q14693
  ENSP ID: ENSP00000379404
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSSLVDCKRTAPHLAVAAEGGLSSSCPPQSSLFHPSESPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 47009 - protein, 459 aa, Homo sapiens
  Payload ID: 9507
  Gene Symbol: LPIN1
  Gene Name: lipin 1
  Uniprot ID: Q14693
  ENSP ID: ENSP00000379405
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSSLVDCKRTAPHLAVAAEGGLSSSCPPQSSLFHPSESPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKK

SEQ ID NO: 47010 - protein, 701 aa, Homo sapiens
  Payload ID: 9507
  Gene Symbol: LPIN1
  Gene Name: lipin 1
  ENSP ID: ENSP00000379406
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSSLVDCKRTAPHLAVAAEGGLSSSCPPQSSLFHPSESPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLLEVEEWPQRRGFQCHHAVPRHVPL

SEQ ID NO: 47011 - protein, 28 aa, Homo sapiens
  Payload ID: 9507
  Gene Symbol: LPIN1
  Gene Name: lipin 1
  ENSP ID: ENSP00000392424
MNYVGQLAGQVFVTVKELYKGLNPATLS

SEQ ID NO: 47012 - protein, 975 aa, Homo sapiens
  Payload ID: 9507
  Gene Symbol: LPIN1
  Gene Name: lipin 1
  Uniprot ID: Q14693
  ENSP ID: ENSP00000397908
MGEQDGIRSSSWETSQGKSSPDSAWSWIPIMRDPGWIRNVWSSNINVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSSLVDCKRTAPHLAVAAEGGLSSSCPPQSSLFHPSESPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 47013 - protein, 896 aa, Homo sapiens
  Payload ID: 9507
  Gene Symbol: LPIN1
  Gene Name: lipin 1
  Uniprot ID: Q14693
  ENSP ID: ENSP00000401522
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 47014 - protein, 96 aa, Homo sapiens
  Payload ID: 9507
  Gene Symbol: LPIN1
  Gene Name: lipin 1
  ENSP ID: ENSP00000412578
MNYVGQLAGQVFVTVKELYKGLNPATLSGCIDIIVIRQPNGNLQCSPFHVRFGKMGVLRSREKVVDIEINGESVDLHMKLGDNGEAFFVQETDNDQ

SEQ ID NO: 47015 - protein, 194 aa, Homo sapiens
  Payload ID: 9507
  Gene Symbol: LPIN1
  Gene Name: lipin 1
  ENSP ID: ENSP00000413714
IDDPNLVVKIGSKYYNWTTAAPLLLAMQAFQKPLPKSSCLSYLHVILDAIRFCFSKIFNAQIATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYL

SEQ ID NO: 47016 - protein, 896 aa, Homo sapiens
  Payload ID: 9508
  Gene Symbol: LPIN2
  Gene Name: lipin 2
  Uniprot ID: Q92539
  ENSP ID: ENSP00000261596
MNYVGQLAGQVIVTVKELYKGINQATLSGCIDVIVVQQQDGSYQCSPFHVRFGKLGVLRSKEKVIDIEINGSAVDLHMKLGDNGEAFFVEETEEEYEKLPAYLATSPIPTEDQFFKDIDTPLVKSGGDETPSQSSDISHVLETETIFTPSSVKKKKRRRKKYKQDSKKEEQAASAAAEDTCDVGVSSDDDKGAQAARGSSNASLKEEECKEPLLFHSGDHYPLSDGDWSPLETTYPQTACPKSDSELEVKPAESLLRSESHMEWTWGGFPESTKVSKRERSDHHPRTATITPSENTHFRVIPSEDNLISEVEKDASMEDTVCTIVKPKPRALGTQMSDPTSVAELLEPPLESTQISSMLDADHLPNAALAEAPSESKPAAKVDSPSKKKGVHKRSQHQGPDDIYLDDLKGLEPEVAALYFPKSESEPGSRQWPESDTLSGSQSPQSVGSAAADSGTECLSDSAMDLPDVTLSLCGGLSENGEISKEKFMEHIITYHEFAENPGLIDNPNLVIRIYNRYYNWALAAPMILSLQVFQKSLPKATVESWVKDKMPKKSGRWWFWRKRESMTKQLPESKEGKSEAPPASDLPSSSKEPAGARPAENDSSSDEGSQELEESITVDPIPTEPLSHGSTTSYKKSLRLSSDQIAKLKLHDGPNDVVFSITTQYQGTCRCAGTIYLWNWNDKIIISDIDGTITKSDALGQILPQLGKDWTHQGIAKLYHSINENGYKFLYCSARAIGMADMTRGYLHWVNDKGTILPRGPLMLSPSSLFSAFHREVIEKKPEKFKIECLNDIKNLFAPSKQPFYAAFGNRPNDVYAYTQVGVPDCRIFTVNPKGELIQERTKGNKSSYHRLSELVEHVFPLLSKEQNSAFPCPEFSSFCYWRDPIPEVDLDDLS

SEQ ID NO: 47017 - protein, 232 aa, Homo sapiens
  Payload ID: 9508
  Gene Symbol: LPIN2
  Gene Name: lipin 2
  ENSP ID: ENSP00000463026
MNYVGQLAGQVIVTVKELYKGINQATLSGCIDVIVVQQQDGSYQCSPFHVRFGKLGVLRSKEKVIDIEINGSAVDLHMKLGDNGEAFFVEETEEEYEKLPAYLATSPIPTEDQFFKDIDTPLVKSGGDETPSQSSDISHVLETETIFTPSSVKKKKRRRKKYKQDSKKEEQAASAAAEDTCDVGVSSDDDKGAQAARGSSNASLKEEECKEPLLFHSGDHYPLSDGDWSPLE

SEQ ID NO: 47018 - protein, 129 aa, Homo sapiens
  Payload ID: 9508
  Gene Symbol: LPIN2
  Gene Name: lipin 2
  ENSP ID: ENSP00000463810
MFYLEDDKEDEVVCKGSLSKTQDVYHDKSPPGILSQTMNYVGQLAGQVIVTVKELYKGINQATLSGCIDVIVVQQQDGSYQCSPFHVRFGKLGVLRSKEKVIDIEINGSAVDLHMKLGDNGEAFFVEET

SEQ ID NO: 47019 - protein, 851 aa, Homo sapiens
  Payload ID: 9509
  Gene Symbol: LPIN3
  Gene Name: lipin 3
  Uniprot ID: Q9BQK8
  ENSP ID: ENSP00000362354
MNYVGQLAETVFGTVKELYRGLNPATLSGGIDVLVVKQVDGSFRCSPFHVRFGKLGVLRSREKVVDIELNGEPVDLHMKLGDSGEAFFVQELESDDEHVPPGLCTSPIPWGGLSGFPSDSQLGTASEPEGLVMAGTASTGRRKRRRRRKPKQKEDAVATDSSPEELEAGAESELSLPEKLRPEPPGVQLEEKSSLQPKDIYPYSDGEWPPQASLSAGELTSPKSDSELEVRTPEPSPLRAESHMQWAWGRLPKVARAERPESSVVLEGRAGATSPPRGGPSTPSTSVAGGVDPLGLPIQQTEAGADLQPDTEDPTLVGPPLHTPETEESKTQSSGDMGLPPASKSWSWATLEVPVPTGQPERVSRGKGSPKRSQHLGPSDIYLDDLPSLDSENAALYFPQSDSGLGARRWSEPSSQKSLRDPNPEHEPEPTLDTVDTIALSLCGGLADSRDISLEKFNQHSVSYQDLTKNPGLLDDPNLVVKINGKHYNWAVAAPMILSLQAFQKNLPKSTMDKLEREKMPRKGGRWWFSWRRRDFLAEERSAQKEKTAAKEQQGEKTEVLSSDDDAPDSPVILEIPSLPPSTPPSTPTYKKSLRLSSDQIRRLNLQEGANDVVFSVTTQYQGTCRCKATIYLWKWDDKVVISDIDGTITKSDALGHILPQLGKDWTHQGITSLYHKIQLNGYKFLYCSARAIGMADLTKGYLQWVSEGGCSLPKGPILLSPSSLFSALHREVIEKKPEVFKVACLSDIQQLFLPHGQPFYAAFGNRPNDVFAYRQVGLPESRIFTVNPRGELIQELIKNHKSTYERLGEVVELLFPPVARGPSTDLANPEYSNFCYWREPLPAVDLDTLD

SEQ ID NO: 47020 - protein, 269 aa, Homo sapiens
  Payload ID: 9509
  Gene Symbol: LPIN3
  Gene Name: lipin 3
  ENSP ID: ENSP00000398092
  MOD_RES (1)..(1): Any amino acid
XVKINGKHYNWAVAAPMILSLQAFQKNLPKRSAQKEKTAAKEQQGEKTEVLSSDDDAPDSPVILEIPSLPPSTPPSTPTYKKSLRLSSDQIRRLNLQEGANDVVFSVTTQYQGTCRCKATIYLWKWDDKVVISDIDGTITKSDALGHILPQLGKDWTHQGITSLYHKIQLNGYKFLYCSARAIGMADLTKGYLQWVSEGGCSLPKGPILLSPSSLFSALHREVIEKKPEVFKVACLSDIQQLFLPHGQPFYAAFGNRPNDVFAYRQVGL

SEQ ID NO: 47021 - protein, 852 aa, Homo sapiens
  Payload ID: 9509
  Gene Symbol: LPIN3
  Gene Name: lipin 3
  Uniprot ID: Q9BQK8
  ENSP ID: ENSP00000487971
MNYVGQLAETVFGTVKELYRGLNPATLSGGIDVLVVKQVDGSFRCSPFHVRFGKLGVLRSREKVVDIELNGEPVDLHMKLGDSGEAFFVQELESDDEHVPPGLCTSPIPWGGLSGFPSDSQLGTASEPEGLVMAGTASTGRRKRRRRRKPKQKEDAVATDSSPEELEAGAESELSLPEKLRPEPPGSVQLEEKSSLQPKDIYPYSDGEWPPQASLSAGELTSPKSDSELEVRTPEPSPLRAESHMQWAWGRLPKVARAERPESSVVLEGRAGATSPPRGGPSTPSTSVAGGVDPLGLPIQQTEAGADLQPDTEDPTLVGPPLHTPETEESKTQSSGDMGLPPASKSWSWATLEVPVPTGQPERVSRGKGSPKRSQHLGPSDIYLDDLPSLDSENAALYFPQSDSGLGARRWSEPSSQKSLRDPNPEHEPEPTLDTVDTIALSLCGGLADSRDISLEKFNQHSVSYQDLTKNPGLLDDPNLVVKINGKHYNWAVAAPMILSLQAFQKNLPKSTMDKLEREKMPRKGGRWWFSWRRRDFLAEERSAQKEKTAAKEQQGEKTEVLSSDDDAPDSPVILEIPSLPPSTPPSTPTYKKSLRLSSDQIRRLNLQEGANDVVFSVTTQYQGTCRCKATIYLWKWDDKVVISDIDGTITKSDALGHILPQLGKDWTHQGITSLYHKIQLNGYKFLYCSARAIGMADLTKGYLQWVSEGGCSLPKGPILLSPSSLFSALHREVIEKKPEVFKVACLSDIQQLFLPHGQPFYAAFGNRPNDVFAYRQVGLPESRIFTVNPRGELIQELIKNHKSTYERLGEVVELLFPPVARGPSTDLANPEYSNFCYWREPLPAVDLDTLD

SEQ ID NO: 47022 - protein, 176 aa, Homo sapiens
  Payload ID: 9510
  Gene Symbol: LCN1
  Gene Name: lipocalin 1
  Uniprot ID: P31025
  ENSP ID: ENSP00000263598
MKPLLLAVSLGLIAALQAHHLLASDEEIQDVSGTWYLKAMTVDREFPEMNLESVTPMTLTTLEGGNLEAKVTMLISGRCQEVKAVLEKTDEPGKYTADGGKHVAYIIRSHVKDHYIFYCEGELHGKPVRGVKLVGRDPKNNLEALEDFEKAAGARGLSTESILIPRQSETCSPGSD

SEQ ID NO: 47023 - protein, 176 aa, Homo sapiens; identical to SEQ ID NO: 47022
  Payload ID: 9510
  Gene Symbol: LCN1
  Gene Name: lipocalin 1
  Uniprot ID: P31025
  ENSP ID: ENSP00000360846

SEQ ID NO: 47024 - protein, 200 aa, Homo sapiens
  Payload ID: 9511
  Gene Symbol: LCN10
  Gene Name: lipocalin 10
  Uniprot ID: Q6JVE6
  ENSP ID: ENSP00000418491
MRQGLLVLALVLVLVLVLAAGSQVQEWYPRESHALNWNKFSGFWYILATATDAQGFLPARDKRKLGASVVKVNKVGQLRVLLAFRRLKGCQSQEVILRKDGKKPVFGNACAYAAGPREGQEGVKGVKAFHVLSTDYSYGLVYLRLGRATQNYKNLLLFHRQNVSSFQSLKEFMDACDILGLSKAAVILPKDASRTHTILP

SEQ ID NO: 47025 - protein, 187 aa, Homo sapiens
  Payload ID: 9511
  Gene Symbol: LCN10
  Gene Name: lipocalin 10
  Uniprot ID: Q6JVE6
  ENSP ID: ENSP00000420564
MRQGLLVLALVLVLVLVLAAGSQVQEWYPRESHALNWNKFSGFWYILATATDAQGFLPARDKRKLGASVVKVNKVGQLRVLLAFRRGQGCGRAQPRHPGTSGHLWASLSVKGVKAFHVLSTDYSYGLVYLRLGRATQNYKNLLLFHRQNVSSFQSLKEFMDACDILGLSKAAVILPKDASRTHTILP

SEQ ID NO: 47026 - protein, 164 aa, Homo sapiens
  Payload ID: 9511
  Gene Symbol: LCN10
  Gene Name: lipocalin 10
  ENSP ID: ENSP00000431726
MRQGLLVLALVLVLVLVLAAGSQVQEWYPRESHALNWNKFSGFWYILATATDAQGFLPARDKRKLGASVVKVNKVGQLRVLLAFRRLKGCQSQEVILRKDGKKPVFGNACAYAAGPREGQEGDRQNVSSFQSLKEFMDACDILGLSKAAVILPKDASRTHTILP

SEQ ID NO: 47027 - protein, 37 aa, Homo sapiens
  Payload ID: 9511
  Gene Symbol: LCN10
  Gene Name: lipocalin 10
  ENSP ID: ENSP00000431930
  MOD_RES (1)..(1): Any amino acid
XTDAQGFLPARDKRKLGASVVKVNKVGQLRVLLAFRR

SEQ ID NO: 47028 - protein, 75 aa, Homo sapiens
  Payload ID: 9511
  Gene Symbol: LCN10
  Gene Name: lipocalin 10
  ENSP ID: ENSP00000434410
MRQGLLVLALVLVLVLVLAAGSQVQEWYPRESHALNWNKGQEEAGGVRGKGEQSGPAPRAPRLQTIGRMFRASRV

SEQ ID NO: 47029 - protein, 86 aa, Homo sapiens
  Payload ID: 9511
  Gene Symbol: LCN10
  Gene Name: lipocalin 10
  ENSP ID: ENSP00000435948
MRQGLLVLALVLVLVLVLAAGSQVQEWYPRESHALNWNKFSGFWYILATATDAQGFLPARDKRKLGASVVKVNKVGQLRVLLAFRR

SEQ ID NO: 47030 - protein, 90 aa, Homo sapiens
  Payload ID: 9512
  Gene Symbol: LCN12
  Gene Name: lipocalin 12
  ENSP ID: ENSP00000360695
TFELSDDGRFEVWNAMTRGQHCDTWSYVLIPAAQPGQFTVDHGVDTRAGWPSSGSACWAGAGCCLPGRWTSSSAWAELRASRMTTSSSQM

SEQ ID NO: 47031 - protein, 192 aa, Homo sapiens
  Payload ID: 9512
  Gene Symbol: LCN12
  Gene Name: lipocalin 12
  Uniprot ID: Q6JVE5
  ENSP ID: ENSP00000360696
MRLLCGLWLWLSLLKVLQAQTPTPLPLPPPMQSFQGNQFQGEWFVLGLAGNSFRPEHRALLNAFTATFELSDDGRFEVWNAMTRGQHCDTWSYVLIPAAQPGQFTVDHGVEPGADREETRVVDSDYTQFALMLSRRHTSRLAVLRISLLGRSWLLPPGTLDQFICLGRAQGLSDDNIVFPDVTGWSPQASVC

SEQ ID NO: 47032 - protein, 102 aa, Homo sapiens
  Payload ID: 9512
  Gene Symbol: LCN12
  Gene Name: lipocalin 12
  ENSP ID: ENSP00000473473
ALLNAFTATFELSDDGRFEVWNAMTRGQHCDTWSYVLIPAAQPGQFTVDHGVGRSWLLPPGTLDQFICLGRAQGLSDDNIVFPDVTGGALDLSSLPWVAAPA

SEQ ID NO: 47033 - protein, 184 aa, Homo sapiens
  Payload ID: 9513
  Gene Symbol: LCN15
  Gene Name: lipocalin 15
  Uniprot ID: Q6UWW0
  ENSP ID: ENSP00000313833
MMSFLLGAILTLLWAPTAQAEVLLQPDFNAEKFSGLWYVVSMASDCRVFLGKKDHLSMSTRAIRPTEEGGLHVHMEFPGADGCNQVDAEYLKVGSEGHFRVPALGYLDVRIVDTDYSSFAVLYIYKELEGALSTMVQLYSRTQDVSPQALKSFQDFYPTLGLPKDMMVMLPQSDACNPESKEAP

SEQ ID NO: 47034 - protein, 198 aa, Homo sapiens
  Payload ID: 9514
  Gene Symbol: LCN2
  Gene Name: lipocalin 2
  Uniprot ID: P80188
  ENSP ID: ENSP00000277480
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 47035 - protein, 200 aa, Homo sapiens
  Payload ID: 9514
  Gene Symbol: LCN2
  Gene Name: lipocalin 2
  ENSP ID: ENSP00000362089
MPLGLLWLGLALLGALHAQAQDSTSDLIPAPPLSKVPLQQNFQDNQFQGKWYVVGLAGNAILREDKDPQKMYATIYELKEDKSYNVTSVLFREKAQKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 47036 - protein, 198 aa, Homo sapiens; identical to SEQ ID NO: 47034
  Payload ID: 9514
  Gene Symbol: LCN2
  Gene Name: lipocalin 2
  Uniprot ID: P80188
  ENSP ID: ENSP00000362108

SEQ ID NO: 47037 - protein, 163 aa, Homo sapiens
  Payload ID: 9515
  Gene Symbol: LCN6
  Gene Name: lipocalin 6
  Uniprot ID: P62502
  ENSP ID: ENSP00000339621
MGGLLLAAFLALVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 47038 - protein, 78 aa, Homo sapiens
  Payload ID: 9515
  Gene Symbol: LCN6
  Gene Name: lipocalin 6
  ENSP ID: ENSP00000468337
MDLIKRNSGWVFENPSIGVLELWVLATNFRDYAIIFTQLEFGDEPFNTVELYSLTETASQEAMGLFTKWSRSLGFLSQ

SEQ ID NO: 47039 - protein, 152 aa, Homo sapiens
  Payload ID: 9516
  Gene Symbol: LCN8
  Gene Name: lipocalin 8
  Uniprot ID: Q6JVE9
  ENSP ID: ENSP00000360753
MEELDRQKIGGFWREVGVASDQSLVLTAPKRVEGLFLTLSGSNLTVKVAYNSSGSCEIEKIVGSEIDSTGKFAFPGHREIHVLDTDYEGYAILRVSLMWRGRNFRVLKYFTRSLEDKDRLGFWKFRELTADTGLYLAARPGRCAELLKEELI

SEQ ID NO: 47040 - protein, 175 aa, Homo sapiens
  Payload ID: 9516
  Gene Symbol: LCN8
  Gene Name: lipocalin 8
  Uniprot ID: Q6JVE9
  ENSP ID: ENSP00000482512
MPGAAEALPTVTVTLVAGAVPPASGALTAHCIGGFWREVGVASDQSLVLTAPKRVEGLFLTLSGSNLTVKVAYNSSGSCEIEKIVGSEIDSTGKFAFPGHREIHVLDTDYEGYAILRVSLMWRGRNFRVLKYFTRSLEDKDRLGFWKFRELTADTGLYLAARPGRCAELLKEELI

SEQ ID NO: 47041 - protein, 176 aa, Homo sapiens
  Payload ID: 9517
  Gene Symbol: LCN9
  Gene Name: lipocalin 9
  Uniprot ID: Q8WX39
  ENSP ID: ENSP00000277526
MALLLLSLGLSLIAAQEFDPHTVMQRNYNVARVSGVWYSIFMASDDLNRIKENGDLRVFVRNIEHLKNGSLIFDFEYMVQGECVAVVVVCEKTEKNGEYSINYEGQNTVAVSETDYRLFITFHLQNFRNGTETHTLALYETCEKYGLGSQNIIDLTNKDPCYSKHYRSPPRPPMRW

SEQ ID NO: 47042 - protein, 176 aa, Homo sapiens [sequence omitted]

SEQ ID NO: 47043 - protein, 164 aa, Homo sapiens
  Payload ID: 9518
  Gene Symbol: LCNL1
  Gene Name: lipocalin-like 1
  Uniprot ID: Q6ZST4
  ENSP ID: ENSP00000386162
MVGVVSDDQDFLDSKDTMKMAVVLVTPLGNGDLALKFGYPTPHGGCQKMDTTFTEGAVPGQFSNPAMALSDIRVAFSDYQHFALLYLEMRKGGLRNQWLQLYGGRAAGRRPRHPRFGSGMSPLCLHQPFLHAEGGTAGSWCLWPRVPAPPCPSLPLFAPPAPSL

SEQ ID NO: 47044 - protein, 372 aa, Homo sapiens
  Payload ID: 9519
  Gene Symbol: LIAS
  Gene Name: lipoic acid synthetase
  Uniprot ID: O43766
  ENSP ID: ENSP00000261434
MSLRCGDAARTLGPRVFGRYFCSPVRPLSSLPDKKKELLQNGPDLQDFVSGDLADRSTWDEYKGNLKRQKGERLRLPPWLKTEIPMGKNYNKLKNTLRNLNLHTVCEEARCPNIGECWGGGEYATATATIMLMGDTCTRGCRFCSVKTARNPPPLDASEPYNTAKAIAEWGLDYVVLTSVDRDDMPDGGAEHIAKTVSYLKERNPKILVECLTPDFRGDLKAIEKVALSGLDVYAHNVETVPELQSKVRDPRANFDQSLRVLKHAKKVQPDVISKTSIMLGLGENDEQVYATMKALREADVDCLTLGQYMQPTRRHLKVEEYITPEKFKYWEKVGNELGFHYTASGPLVRSSYKAGEFFLKNLVAKRKTKDL

SEQ ID NO: 47045 - protein, 322 aa, Homo sapiens
  Payload ID: 9519
  Gene Symbol: LIAS
  Gene Name: lipoic acid synthetase
  Uniprot ID: O43766
  ENSP ID: ENSP00000340676
MSLRCGDAARTLGPRVFGRYFCSPVRPLSSLPDKKKELLQNGPDLQDFVSGDLADRSTWDEYKGNLKRQKGERLRLPPWLKTEIPMGKNYNKLKNTLRNLNLHTVCEEARCPNIGECWGGGEYATATATIMLMGDTCTRGCRFCSVKTARNPPPLDASEPYNTAKAIAEWGLDYVVLTSVDRDDMPDGGAEHIAKTVSYLKERNPKILVECLTPDFRGDLKAIEKVALSGLDVYAHNVETVPELQSKVRDPRANFDQSLRVLKHAKKVQPDVISKTSIMLGLGENDEQVYATMKALREADVDCLTLGQYMQPTRRHLKVNFS

SEQ ID NO: 47046 - protein, 329 aa, Homo sapiens
  Payload ID: 9519
  Gene Symbol: LIAS
  Gene Name: lipoic acid synthetase
  Uniprot ID: O43766
  ENSP ID: ENSP00000371270
MSLRCGDAARTLGPRVFGRYFCSPVRPLSSLPDKKKELLQNGPDLQDFVSGDLADRSTWDEYKGNLKRQKGERLRLPPWLKTEIPMGKNYNKLKNTLRNLNLHTVCEEARCPNIGECWGGGEYATATATIMLMGDTCTRGCRFCSVKTARNPPPLDASEPYNTAKAIAEWGLDYVVLTSVDRDDMPDGGAEHIAKTVSYLKESKVRDPRANFDQSLRVLKHAKKVQPDVISKTSIMLGLGENDEQVYATMKALREADVDCLTLGQYMQPTRRHLKVEEYITPEKFKYWEKVGNELGFHYTASGPLVRSSYKAGEFFLKNLVAKRKTKDL

SEQ ID NO: 47047 - protein, 242 aa, Homo sapiens
  Payload ID: 9519
  Gene Symbol: LIAS
  Gene Name: lipoic acid synthetase
  ENSP ID: ENSP00000425580
MSLRCGDAARTLGPRVFGRYFCSPVRPLSSLPDKKKELLQNGPDLQDFVSGDLADRSTWDEYKGNLKRQKGERNPKILVECLTPDFRGDLKAIEKVALSGLDVYAHNVETVPELQSKVRDPRANFDQSLRVLKHAKKVQPDVISKTSIMLGLGENDEQVYATMKALREADVDCLTLGQYMQPTRRHLKVEEYITPEKFKYWEKVGNELGFHYTASGPLVRSSYKAGEFFLKNLVAKRKTKDL

SEQ ID NO: 47048 - protein, 591 aa, Homo sapiens
  Payload ID: 9520
  Gene Symbol: LSR
  Gene Name: lipolysis stimulated lipoprotein receptor
  Uniprot ID: Q86X29
  ENSP ID: ENSP00000262627
MQQDGLGVGTRNGSGKGRSVHPSWPWCAPRPLRYFGRDARARRAQTAAMALAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 47049 - protein, 630 aa, Homo sapiens
  Payload ID: 9520
  Gene Symbol: LSR
  Gene Name: lipolysis stimulated lipoprotein receptor
  Uniprot ID: Q86X29
  ENSP ID: ENSP00000346976
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 47050 - protein, 581 aa, Homo sapiens
  Payload ID: 9520
  Gene Symbol: LSR
  Gene Name: lipolysis stimulated lipoprotein receptor
  Uniprot ID: Q86X29
  ENSP ID: ENSP00000354034
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLVYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 47051 - protein, 649 aa, Homo sapiens
  Payload ID: 9520
  Gene Symbol: LSR
  Gene Name: lipolysis stimulated lipoprotein receptor
  Uniprot ID: Q86X29
  ENSP ID: ENSP00000354575
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 47052 - protein, 493 aa, Homo sapiens
  Payload ID: 9520
  Gene Symbol: LSR
  Gene Name: lipolysis stimulated lipoprotein receptor
  Uniprot ID: Q86X29
  ENSP ID: ENSP00000394479
MALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGMYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 47053 - protein, 114 aa, Homo sapiens
  Payload ID: 9520
  Gene Symbol: LSR
  Gene Name: lipolysis stimulated lipoprotein receptor
  ENSP ID: ENSP00000470630
DSVRTVRVVATKQGNAVTLGDYYQGRRITITGNADLTFDQTAWGDSGVYYCSVVSAQDLQGNNEAYAELIVLGRTSGVAELLPGFQAGPIEVYAAGKAATSGVPSIYAPSTYAH

SEQ ID NO: 47054 - protein, 51 aa, Homo sapiens
  Payload ID: 9520
  Gene Symbol: LSR
  Gene Name: lipolysis stimulated lipoprotein receptor
  ENSP ID: ENSP00000471486
MQQDGLGVGTRNGSGKGRSVHPSWPWCAPRPLSSCQGHPGDRVQPLPRGDP

SEQ ID NO: 47055 - protein, 139 aa, Homo sapiens
  Payload ID: 9520
  Gene Symbol: LSR
  Gene Name: lipolysis stimulated lipoprotein receptor
  ENSP ID: ENSP00000472154
MTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFL

SEQ ID NO: 47056 - protein, 629 aa, Homo sapiens
  Payload ID: 9520
  Gene Symbol: LSR
  Gene Name: lipolysis stimulated lipoprotein receptor
  Uniprot ID: Q86X29
  ENSP ID: ENSP00000472569
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 47057 - protein, 601 aa, Homo sapiens
  Payload ID: 9520
  Gene Symbol: LSR
  Gene Name: lipolysis stimulated lipoprotein receptor
  ENSP ID: ENSP00000474797
MALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 47058 - protein, 649 aa, Homo sapiens; identical to SEQ ID NO: 47051
  Payload ID: 9520
  Gene Symbol: LSR
  Gene Name: lipolysis stimulated lipoprotein receptor
  Uniprot ID: Q86X29
  ENSP ID: ENSP00000480821

SEQ ID NO: 47059 - protein, 200 aa, Homo sapiens
  Payload ID: 9521
  Gene Symbol: LHFP
  Gene Name: lipoma HMGIC fusion partner
  Uniprot ID: Q9Y693
  ENSP ID: ENSP00000368908
MASSLTCTGVIWALLSFLCAATSCVGFFMPYWLWGSQLGKPVSFGTFRRCSYPVHDESRQMMVMVEECGRYASFQGIPSAEWRICTIVTGLGCGLLLLVALTALMGCCVSDLISRTVGRVAGGIQFLGGLLIGAGCALYPLGWDSEEVRQTCGYTSGQFDLGKCEIGWAYYCTGAGATAAMLLCTWLACFSGKKQKHYPY

SEQ ID NO: 47060 - protein, 220 aa, Homo sapiens
  Payload ID: 9522
  Gene Symbol: LHFPL1
  Gene Name: lipoma HMGIC fusion partner-like 1
  Uniprot ID: Q86WI0
  ENSP ID: ENSP00000361036
MRSSLTMVGTLWAFLSLVTAVTSSTSYFLPYWLFGSQMGKPVSFSTFRRCNYPVRGEGHSLIMVEECGRYASFNAIPSLAWQMCTVVTGAGCALLLLVALAAVLGCCMEELISRMMGRCMGAAQFVGGLLISSGCALYPLGWNSPEIMQTCGNVSNQFQLGTCRLGWAYYCAGGGAAAAMLICTWLSCFAGRNPKPVILVESIMRNTNSYAMELDHCLKP

SEQ ID NO: 47061 - protein, 228 aa, Homo sapiens
  Payload ID: 9523
  Gene Symbol: LHFPL2
  Gene Name: lipoma HMGIC fusion partner-like 2
  Uniprot ID: Q6ZUX7
  ENSP ID: ENSP00000369702
MCHVIVTCRSMLWTLLSIVVAFAELIAFMSADWLIGKARSRGGVEPAGPGGGSPEPYHPTLGIYARCIRNPGVQHFQRDTLCGPYAESFGEIASGFWQATAIFLAVGIFILCMVALVSVFTMCVQSIMKKSIFNVCGLLQGIAGLFLILGLILYPAGWGCQKAIDYCGHYASAYKPGDCSLGWAFYTAIGGTVLTFICAVFSAQAEIATSSDKVQEEIEEGKNLICLL

SEQ ID NO: 47062 - protein, 228 aa, Homo sapiens; identical to SEQ ID NO: 47061
  Payload ID: 9523
  Gene Symbol: LHFPL2
  Gene Name: lipoma HMGIC fusion partner-like 2
  Uniprot ID: Q6ZUX7
  ENSP ID: ENSP00000425906

SEQ ID NO: 47063 - protein, 218 aa, Homo sapiens
  Payload ID: 9524
  Gene Symbol: LHFPL3
  Gene Name: lipoma HMGIC fusion partner-like 3
  ENSP ID: ENSP00000385374
MLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKDDGNA

SEQ ID NO: 47064 - protein, 222 aa, Homo sapiens
  Payload ID: 9524
  Gene Symbol: LHFPL3
  Gene Name: lipoma HMGIC fusion partner-like 3
  Uniprot ID: Q86UP9
  ENSP ID: ENSP00000393128
MLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKVLLSQYSLE

SEQ ID NO: 47065 - protein, 247 aa, Homo sapiens
  Payload ID: 9525
  Gene Symbol: LHFPL4
  Gene Name: lipoma HMGIC fusion partner-like 4
  Uniprot ID: Q7Z7J7
  ENSP ID: ENSP00000287585
MLPSQEASKLYHEHYMRNSRAIGVLWAIFTICFAIINVVVFIQPYWVGDSVSTPKPGYFGLFHYCVGSGLAGRELTCRGSFTDFSTIPSSAFKAAAFFVLLSMVLILGCITCFSLFFFCNTATVYKICAWMQLLAALCLVLGCMIFPDGWDAETIRDMCGAKTGKYSLGDCSVRWAYILAIIGILNALILSFLAFVLGNRQTDLLQEELKPENKDFVGSTVSSVLRPGGDVSGWGVLPCPVAHSQGP

SEQ ID NO: 47066 - protein, 219 aa, Homo sapiens
  Payload ID: 9526
  Gene Symbol: LHFPL5
  Gene Name: lipoma HMGIC fusion partner-like 5
  Uniprot ID: Q8TAF8
  ENSP ID: ENSP00000353346
MVKLLPAQEAAKIYHTNYVRNSRAVGVMWGTLTICFSVLVMALFIQPYWIGDSVNTPQAGYFGLFSYCVGNVLSSELICKGGPLDFSSIPSRAFKTAMFFVALGMFLIIGSIICFSLFFICNTATVYKICAWMQLAAATGLMIGCLVYPDGWDSSEVRRMCGEQTGKYTLGHCTIRWAFMLAILSIGDALILSFLAFVLGYRQDKLLPDDYKADGTEEV

SEQ ID NO: 47067 - protein, 481 aa, Homo sapiens
  Payload ID: 9527
  Gene Symbol: LBP
  Gene Name: lipopolysaccharide binding protein
  Uniprot ID: P18428
  ENSP ID: ENSP00000217407
MGALARALPSILLALLLTSTPEALGANPGLVARITDKGLQYAAQEGLLALQSELLRITLPDFTGDLRIPHVGRGRYEFHSLNIHSCELLHSALRPVPGQGLSLSISDSSIRVQGRWKVRKSFFKLQGSFDVSVKGISISVNLLLGSESSGRPTVTASSCSSDIADVEVDMSGDLGWLLNLFHNQIESKFQKVLESRICEMIQKSVSSDLQPYLQTLPVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRLARLYPNMNLELQGSVPSAPLLNFSPGNLSVDPYMEIDAFVLLPSSSKEPVFRLSVATNVSATLTFNTSKITGFLKPGKVKVELKESKVGLFNAELLEALLNYYILNTFYPKFNDKLAEGFPLPLLKRVQLYDLGLQIHKDFLFLGANVQYMRV

SEQ ID NO: 47068 - protein, 161 aa, Homo sapiens
  Payload ID: 9528
  Gene Symbol: LITAF
  Gene Name: lipopolysaccharide-induced TNF factor
  Uniprot ID: Q99732
  ENSP ID: ENSP00000340118
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 47069 - protein, 228 aa, Homo sapiens
  Payload ID: 9528
  Gene Symbol: LITAF
  Gene Name: lipopolysaccharide-induced TNF factor
  Uniprot ID: Q99732
  ENSP ID: ENSP00000371231
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGVHSGLLLHPLLRGCPAGRGPLLSQLQSSPGHLQAFVGLSQTWREPGAAGSPFHLSSSFTPGGGSALVVSPLQGAHLHVFFWGEYVAKLTNLQTPEIAAWSRA

SEQ ID NO: 47070 - protein, 152 aa, Homo sapiens
  Payload ID: 9528
  Gene Symbol: LITAF
  Gene Name: lipopolysaccharide-induced TNF factor
  Uniprot ID: Q99732
  ENSP ID: ENSP00000397958
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGQECSGTIVALRSFDLLGSCNPPSSAS

SEQ ID NO: 47071 - protein, 33 aa, Homo sapiens
  Payload ID: 9528
  Gene Symbol: LITAF
  Gene Name: lipopolysaccharide-induced TNF factor
  ENSP ID: ENSP00000458538
MTFVNCHGAGGSVAVRKTRVRPRRRLGFGKMSV

SEQ ID NO: 47072 - protein, 68 aa, Homo sapiens
  Payload ID: 9528
  Gene Symbol: LITAF
  Gene Name: lipopolysaccharide-induced TNF factor
  ENSP ID: ENSP00000458836
MCCPSCNKMIVSQLSYNAGALTWLSCGSLCLLGCIAGCCFIPFCVDALQDVDHYCPNCRALLGTYKRL

SEQ ID NO: 47073 - protein, 137 aa, Homo sapiens
  Payload ID: 9528
  Gene Symbol: LITAF
  Gene Name: lipopolysaccharide-induced TNF factor
  ENSP ID: ENSP00000458871
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFC

SEQ ID NO: 47074 - protein, 136 aa, Homo sapiens
  Payload ID: 9528
  Gene Symbol: LITAF
  Gene Name: lipopolysaccharide-induced TNF factor
  ENSP ID: ENSP00000458981
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGQECSGTIVAL

SEQ ID NO: 47075 - protein, 39 aa, Homo sapiens
  Payload ID: 9528
  Gene Symbol: LITAF
  Gene Name: lipopolysaccharide-induced TNF factor
  ENSP ID: ENSP00000459026
MSVPGPYQAATGPSSAPSAPPSYEETVAVNSYYPTPPAP

SEQ ID NO: 47076 - protein, 10 aa, Homo sapiens
  Payload ID: 9528
  Gene Symbol: LITAF
  Gene Name: lipopolysaccharide-induced TNF factor
  ENSP ID: ENSP00000459094
  MOD_RES (1)..(1): Any amino acid
XRSDSAKESK

SEQ ID NO: 47077 - protein, 161 aa, Homo sapiens; identical to SEQ ID NO: 47068
  Payload ID: 9528
  Gene Symbol: LITAF
  Gene Name: lipopolysaccharide-induced TNF factor
  Uniprot ID: Q99732
  ENSP ID: ENSP00000459138

SEQ ID NO: 47078 - protein, 161 aa, Homo sapiens; identical to SEQ ID NO: 47068
  Payload ID: 9528
  Gene Symbol: LITAF
  Gene Name: lipopolysaccharide-induced TNF factor
  Uniprot ID: Q99732
  ENSP ID: ENSP00000459533

SEQ ID NO: 47079 - protein, 75 aa, Homo sapiens
  Payload ID: 9528
  Gene Symbol: LITAF
  Gene Name: lipopolysaccharide-induced TNF factor
  ENSP ID: ENSP00000459603
MSVPGPYQAATGPSSAPSAPPSYEETVAVNSYYPTPPAPMPGPTTGLVTGPDGKGMNPPSYYTQPAPIPNNNPSA

SEQ ID NO: 47080 - protein, 88 aa, Homo sapiens
  Payload ID: 9528
  Gene Symbol: LITAF
  Gene Name: lipopolysaccharide-induced TNF factor
  ENSP ID: ENSP00000459898
MTFVNCHGAGGSVAVRKTRVRPRRRLGFGKMSVPGPYQAATGPSSAPSAPPSYEETVAVNSYYPTPPAPMPGPTTGLVTGPDGKGMNP

SEQ ID NO: 47081 - protein, 105 aa, Homo sapiens
  Payload ID: 9528
  Gene Symbol: LITAF
  Gene Name: lipopolysaccharide-induced TNF factor
  ENSP ID: ENSP00000459913
MSVPGPYQAATGPSSAPSAPPSYEETVAVNSYYPTPPAPMPGPTTGLVTGPDGKGMNPPSYYTQPAPIPNNNPSTCGLPGPPYHSLALHPGNQESDRSDSAKESK

SEQ ID NO: 47082 - protein, 126 aa, Homo sapiens
  Payload ID: 9528
  Gene Symbol: LITAF
  Gene Name: lipopolysaccharide-induced TNF factor
  ENSP ID: ENSP00000460133
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLG

SEQ ID NO: 47083 - protein, 153 aa, Homo sapiens
  Payload ID: 9528
  Gene Symbol: LITAF
  Gene Name: lipopolysaccharide-induced TNF factor
  ENSP ID: ENSP00000460743
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRA

SEQ ID NO: 47084 - protein, 81 aa, Homo sapiens
  Payload ID: 9528
  Gene Symbol: LITAF
  Gene Name: lipopolysaccharide-induced TNF factor
  ENSP ID: ENSP00000460873
MSVPGPYQAATGPSSAPSAPPSYEETVAVNSYYPTPPAPMPGPTTGLVTGPDGKGMNPPSYYTQPAPIPNNNPMNAIGLVS

SEQ ID NO: 47085 - protein, 161 aa, Homo sapiens; identical to SEQ ID NO: 47068
  Payload ID: 9528
  Gene Symbol: LITAF
  Gene Name: lipopolysaccharide-induced TNF factor
  Uniprot ID: Q99732
  ENSP ID: ENSP00000461667

SEQ ID NO: 47086 - protein, 161 aa, Homo sapiens; identical to SEQ ID NO: 47068
  Payload ID: 9528
  Gene Symbol: LITAF
  Gene Name: lipopolysaccharide-induced TNF factor
  Uniprot ID: Q99732
  ENSP ID: ENSP00000461813

SEQ ID NO: 47087 - protein, 152 aa, Homo sapiens; identical to SEQ ID NO: 47070
  Payload ID: 9528
  Gene Symbol: LITAF
  Gene Name: lipopolysaccharide-induced TNF factor
  Uniprot ID: Q99732
  ENSP ID: ENSP00000481589

SEQ ID NO: 47088 - protein, 161 aa, Homo sapiens; identical to SEQ ID NO: 47068
  Payload ID: 9528
  Gene Symbol: LITAF
  Gene Name: lipopolysaccharide-induced TNF factor
  Uniprot ID: Q99732
  ENSP ID: ENSP00000483114

SEQ ID NO: 47089 - protein, 475 aa, Homo sapiens
  Payload ID: 9529
  Gene Symbol: LPL
  Gene Name: lipoprotein lipase
  Uniprot ID: P06858
  ENSP ID: ENSP00000309757
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYLKTRSQMPYKVFHYQVKIHFSGTESETHTNQAFEISLYGTVAESENIPFTLPEVSTNKTYSFLIYTEVDIGELLMLKLKWKSDSYFSWSDWWSSPGFAIQKIRVKAGETQKKVIFCSREKVSHLQKGKAPAVFVKCHDKSLNKKSG

SEQ ID NO: 47090 - protein, 129 aa, Homo sapiens
  Payload ID: 9529
  Gene Symbol: LPL
  Gene Name: lipoprotein lipase
  ENSP ID: ENSP00000428237
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTK

SEQ ID NO: 47091 - protein, 115 aa, Homo sapiens
  Payload ID: 9529
  Gene Symbol: LPL
  Gene Name: lipoprotein lipase
  ENSP ID: ENSP00000428496
MVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEY

SEQ ID NO: 47092 - protein, 105 aa, Homo sapiens
  Payload ID: 9529
  Gene Symbol: LPL
  Gene Name: lipoprotein lipase
  ENSP ID: ENSP00000428557
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPD

SEQ ID NO: 47093 - protein, 39 aa, Homo sapiens
  Payload ID: 9529
  Gene Symbol: LPL
  Gene Name: lipoprotein lipase
  ENSP ID: ENSP00000431028
MESKALLVLTLAVWLQSLTASRGGVAAADLILKLQIFKF

SEQ ID NO: 47094 - protein, 2040 aa, Homo sapiens
  Payload ID: 9530
  Gene Symbol: LPA
  Gene Name: lipoprotein, Lp(a)
  Uniprot ID: P08519
  ENSP ID: ENSP00000321334
MEHKEVVLLLLLFLKSAAPEQSHVVQDCYHGDGQSYRGTYSTTVTGRTCQAWSSMTPHQHNRTTENYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 47095 - protein, 613 aa, Homo sapiens
  Payload ID: 9530
  Gene Symbol: LPA
  Gene Name: lipoprotein, Lp(a)
  Uniprot ID: P08519
  ENSP ID: ENSP00000395608
SGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVP

SEQ ID NO: 47096 - protein, 571 aa, Homo sapiens
  Payload ID: 9530
  Gene Symbol: LPA
  Gene Name: lipoprotein, Lp(a)
  ENSP ID: ENSP00000480589
SGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNA

SEQ ID NO: 47097 - protein, 1114 aa, Homo sapiens
  Payload ID: 9531
  Gene Symbol: LOXHD1
  Gene Name: lipoxygenase homology domains 1
  Uniprot ID: Q8IVV2
  ENSP ID: ENSP00000300591
MNNEITYYFPCQRWLAVEEDDGQLSRELLPVDESYVLPQSEEGRGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKDGAETLTFPCDRWLATSEDDKKTIRELVPYDIFTEKYMKDGSLRQVYKEVEEPLDIVLYSVQIFTGNIPGAGTDAKVYITIYGDLGDTGERYLGKSENRTNKFERGTADTFIIEAADLGVIYKIKLRHDNSKWCADWYVEKVEIWNDTNEDEFLFLCGRWLSLKKEDGRLERLFYEKEYTGDRSSNCSSPADFWEIALSSKMADVDISTVTGPMADYVQEGPIIPYYVSVTTGKHKDAATDSRAFIFLIGEDDERSKRIWLDYPRGKRGFSRGSVEEFYVAGLDVGIIKKIELGHDGASPESCWLVEELCLAVPTQGTKYMLNCNCWLAKDRGDGITSRVFDLLDAMVVNIGVKVLYEMTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELVVTRLGLAAECG

SEQ ID NO: 47098 - protein, 512 aa, Homo sapiens
  Payload ID: 9531
  Gene Symbol: LOXHD1
  Gene Name: lipoxygenase homology domains 1
  Uniprot ID: Q8IVV2
  ENSP ID: ENSP00000381676
MTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELGELRKVRLEHDSSGYCSGWLVEKVEVTNTSTGVATIFNCGRWLDKKRGDGLTWRDLFPSV

SEQ ID NO: 47099 - protein, 457 aa, Homo sapiens
  Payload ID: 9531
  Gene Symbol: LOXHD1
  Gene Name: lipoxygenase homology domains 1
  Uniprot ID: Q8IVV2
  ENSP ID: ENSP00000381692
MTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELGELRK

SEQ ID NO: 47100 - protein, 2067 aa, Homo sapiens
  Payload ID: 9531
  Gene Symbol: LOXHD1
  Gene Name: lipoxygenase homology domains 1
  ENSP ID: ENSP00000387621
MMPQKKRRRKKDIDFLALYEAELLNYASEDDEGELEHEYYKARVYEVVTATGDVRGAGTDANVFITLFGENGLSPKLQLTSKSKSAFEKGNVDVFRVRTNNVGLIYKVRIEHDNTGLNASWYLDHVIVTDMKRPHLRYYFNCNNWLSKVEGDRQWCRDLLASFNPMDMPRGNKYEVKVYTGDVIGAGTDADVFINIFGEYGDTGERRLENEKDNFEKGAEDRFILDAPDLGQLMKINVGHNNKGGSAGWFLSQIVIEDIGNKRKYDFPLNRWLALDEDDGKIQRDILVGGAETTAITYIVTVFTGDVRGAGTKSKIYLVMYGARGNKNSGKIFLEGGVFDRGRTDIFHIELAVLLSPLSRVSVGHGNVGVNRGWFCEKVVILCPFTGIQQTFPCSNWLDEKKADGLIERQLYEMVSLRKKRLKKFPWSLWVWTTDLKKAGTNSPIFIQIYGQKGRTDEILLNPNNKWFKPGIIEKFRIELPDLGRFYKIRVWHDKRSSGSGWHLERMTLMNTLNKDKYNFNCNRWLDANEDDNEIVREMTAEGPTVRRIMGMARYHVTVCTGELEGAGTDANVYLCLFGDVGDTGERLLYNCRNNTDLFEKGNADEFTIESVTMRNVRRVRIRHDGKGSGSGWYLDRVLVREEGQPESDNVEFPCLRWLDKDKDDGQLVRELLPSDSSATLKNFRYHISLKTGDVSGASTDSRVYIKLYGDKSDTIKQVLLVSDNNLKDYFERGRVDEFTLETLNIGNINRLVIGHDSTGMHASWFLGSVQIRVPRQGKQYTFPANRWLDKNQADGRLEVELYPSEVVEIQKLVHYEVEIWTGDVGGAGTSARVYMQIYGEKGKTEVLFLSSRSKVFERASKDTFQTDTFTIYAIDLGALTKIRIRHDNTGNRAGWFLDRIDITDMNNEITYYFPCQRWLAVEEDDGQLSRELLPVDESYVLPQSEEGRGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKDGAETLTFPCDRWLATSEDDKKTIRELVPYDIFTEKYMKDGSLRQVYKEVEEPLDIVLYSVQIFTGNIPGAGTDAKVYITIYGDLGDTGERYLGKSENRTNKFERGTADTFIIEAADLGVIYKIKLRHDNSKWCADWYVEKVEIWNDTNEDEFLFLCGRWLSLKKEDGRLERLFYEKEYTGDRSSNCSSPADFWEIALSSKMADVDISTVTGPMADYVQEGPIIPYYVSVTTGKHKDAATDSRAFIFLIGEDDERSKRIWLDYPRGKRGFSRGSVEEFYVAGLDVGIIKKIELGHDGASPESCWLVEELCLAVPTQGTKYMLNCNCWLAKDRGDGITSRVFDLLDAMVVNIGVKVLYEMTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELGELRKVRLEHDSSGYCSGWLVEKVEVTNTSTGVATIFNCGRWLDKKRGDGLTWRDLFPSV

SEQ ID NO: 47101 - protein, 180 aa, Homo sapiens
  Payload ID: 9531
  Gene Symbol: LOXHD1
  Gene Name: lipoxygenase homology domains 1
  ENSP ID: ENSP00000392440
MTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFP

SEQ ID NO: 47102 - protein, 23 aa, Homo sapiens
  Payload ID: 9531
  Gene Symbol: LOXHD1
  Gene Name: lipoxygenase homology domains 1
  ENSP ID: ENSP00000412568
MNNEITYYFPCQRWLAVEEDDGQ

SEQ ID NO: 47103 - protein, 57 aa, Homo sapiens
  Payload ID: 9531
  Gene Symbol: LOXHD1
  Gene Name: lipoxygenase homology domains 1
  ENSP ID: ENSP00000414278
MGFLDQVRSCPTKVLYEMTVWTGDVVGGGTDSNIFMTLYGINGSTEEMQLDKKKARF

SEQ ID NO: 47104 - protein, 306 aa, Homo sapiens
  Payload ID: 9531
  Gene Symbol: LOXHD1
  Gene Name: lipoxygenase homology domains 1
  ENSP ID: ENSP00000440060
MRLGTNCEHPQLPLAAPSGYYFPCQRWLAVEEDDGQLSRELLPVDESYVLPQSEEGRGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKD

SEQ ID NO: 47105 - protein, 2211 aa, Homo sapiens
  Payload ID: 9531
  Gene Symbol: LOXHD1
  Gene Name: lipoxygenase homology domains 1
  ENSP ID: ENSP00000444586
MMPQKKRRRKKDIDFLALYEAELLNYASEDDEGELEHEYYKARVYEVVTATGDVRGAGTDANVFITLFGENGLSPKLQLTSKSKSAFEKGNVDVFRVRTNNVGLIYKVRIEHDNTGLNASWYLDHVIVTDMKRPHLRYYFNCNNWLSKVEGDRQWCRDLLASFNPMDMPRGNKYEVKVYTGDVIGAGTDADVFINIFGEYGDTGERRLENEKDNFEKGAEDRFILDAPDLGQLMKINVGHNNKGGSAGWFLSQIVIEDIGNKRKYDFPLNRWLALDEDDGKIQRDILVGGAETTAITYIVTVFTGDVRGAGTKSKIYLVMYGARGNKNSGKIFLEGGVFDRGRTDIFHIELAVLLSPLSRVSVGHGNVGVNRGWFCEKVVILCPFTGIQQTFPCSNWLDEKKADGLIERQLYEMVSLRKKRLKKFPWSLWVWTTDLKKAGTNSPIFIQIYGQKGRTDEILLNPNNKWFKPGIIEKFRIELPDLGRFYKIRVWHDKRSSGSGWHLERMTLMNTLNKDKYNFNCNRWLDANEDDNEIVREMTAEGPTVRRIMGMARYHVTVCTGELEGAGTDANVYLCLFGDVGDTGERLLYNCRNNTDLFEKGNADEFTIESVTMRNVRRVRIRHDGKGSGSGWYLDRVLVREEGQPESDNVEFPCLRWLDKDKDDGQLVRELLPSDSSATLKNFRYHISLKTGDVSGASTDSRVYIKLYGDKSDTIKQVLLVSDNNLKDYFERGRVDEFTLETLNIGNINRLVIGHDSTGMHASWFLGSVQIRVPRQGKQYTFPANRWLDKNQADGRLEVELYPSEVVEIQKLVHYEVEIWTGDVGGAGTSARVYMQIYGEKGKTEVLFLSSRSKVFERASKDTFQLEAADVGEVYKLRLGHTGEGFGPSWFVDTVWLRHLVVREVDLTPEEEARKKKEKDKLRQLLKKERLKAKLQRKKKKRKGSDEEDEGEEEESSSSEESSSEEEEMEEEEEEEEFGPGMQEVIEQHKFEAHRWLARGKEDNELVVELVPAGKPGPERNTYEVQVVTGNVPKAGTDANVYLTIYGEEYGDTGERPLKKSDKSNKFEQGQTDTFTIYAIDLGALTKIRIRHDNTGNRAGWFLDRIDITDMNNEITYYFPCQRWLAVEEDDGQLSRELLPVDESYVLPQSEEGRGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKDGAETLTFPCDRWLATSEDDKKTIRELVPYDIFTEKYMKDGSLRQVYKEVEEPLDIVLYSVQIFTGNIPGAGTDAKVYITIYGDLGDTGERYLGKSENRTNKFERGTADTFIIEAADLGVIYKIKLRHDNSKWCADWYVEKVEIWNDTNEDEFLFLCGRWLSLKKEDGRLERLFYEKEYTGDRSSNCSSPADFWEIALSSKMADVDISTVTGPMADYVQEGPIIPYYVSVTTGKHKDAATDSRAFIFLIGEDDERSKRIWLDYPRGKRGFSRGSVEEFYVAGLDVGIIKKIEVLYEMTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELGELRKVRLEHDSSGYCSGWLVEKVEVTNTSTGVATIFNCGRWLDKKRGDGLTWRDLFPSV

SEQ ID NO: 47106 - protein, 1100 aa, Homo sapiens
  Payload ID: 9531
  Gene Symbol: LOXHD1
  Gene Name: lipoxygenase homology domains 1
  ENSP ID: ENSP00000461964
MNNEITYYFPCQRWLAVEEDDGQLSRELLPVDESYVLPQSEEGRGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKDGAETLTFPCDRWLATSEDDKKTIRELVPYDIFTEKYMKDGSLRQVYKEVEEPLDIVLYSVQIFTGNIPGAGTDAKVYITIYGDLGDTGERYLGKSENRTNKFERGTADTFIIEAADLGVIYKIKLRHDNSKWCADWYVEKVEIWNDTNEDEFLFLCGRWLSLKKEDGRLERLFYEKEYTGDRSSNCSSPADFWEIALSSKMADVDISTVTGPMADYVQEGPIIPYYVSVTTGKHKDAATDSRAFIFLIGEDDERSKRIWLDYPRGKRGFSRGSVEEFYVAGLDVGIIKKIEVLYEMTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELGELRKVRLEHDSSGYCSGWLVEKVEVTNTSTGVATIFNCGRWLDKKRGDGLTWRDLFPSV

SEQ ID NO: 47107 - protein, 1011 aa, Homo sapiens
  Payload ID: 9531
  Gene Symbol: LOXHD1
  Gene Name: lipoxygenase homology domains 1
  ENSP ID: ENSP00000463285
MTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKDGAETLTFPCDRWLATSEDDKKTIRELVPYDIFTEKYMKDGSLRQVYKEVEEPLDIVLYSVQIFTGNIPGAGTDAKVYITIYGDLGDTGERYLGKSENRTNKFERGTADTFIIEAADLGVIYKIKLRHDNSKWCADWYVEKVEIWNDTNEDEFLFLCGRWLSLKKEDGRLERLFYEKEYTGDRSSNCSSPADFWEIALSSKMADVDISTVTGPMADYVQEGPIIPYYVSVTTGKHKDAATDSRAFIFLIGEDDERSKRIWLDYPRGKRGFSRGSVEEFYVAGLDVGIIKKIELGHDGASPESCWLVEELCLAVPTQGTKYMLNCNCWLAKDRGDGITSRVFDLLDAMVVNIGVKVLYEMTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELGELRK

SEQ ID NO: 47108 - protein, 231 aa, Homo sapiens
  Payload ID: 9532
  Gene Symbol: LIPT2
  Gene Name: lipoyl(octanoyl) transferase 2 (putative)
  Uniprot ID: A6NK58
  ENSP ID: ENSP00000309463
MRQPAVRLVRLGRVPYAELLGLQDRWLRRLQAEPGIEAPSGTEAGALLLCEPAGPVYTAGLRGGLTPEETARLRALGAEVRVTGRGGLATFHGPGQLLCHPVLDLRRLGLRLRMHVASLEACAVRLCELQGLQDARARPPPYTGVWLDDRKICAIGVRCGRHITSHGLALNCSTDLTWFEHIVPCGLVGTGVTSLSKELQRHVTVEEVMPPFLVAFKEIYKCTLISEDSPN

SEQ ID NO: 47109 - protein, 78 aa, Homo sapiens
  Payload ID: 9532
  Gene Symbol: LIPT2
  Gene Name: lipoyl(octanoyl) transferase 2 (putative)
  ENSP ID: ENSP00000431210
  MOD_RES (1)..(1): Any amino acid
XGLQDARARPPPYTGVWLDDRKICAIGERRGAGRYLRAEESAVEGTSHPTAWLSTALPTSRGLSTSCPVDWLGQASLP

SEQ ID NO: 47110 - protein, 73 aa, Homo sapiens
  Payload ID: 9532
  Gene Symbol: LIPT2
  Gene Name: lipoyl(octanoyl) transferase 2 (putative)
  ENSP ID: ENSP00000433005
  MOD_RES (1)..(1): Any amino acid
XLGLQDRWLRRLQAEPGIEAPSGTEAGALLLCEPAGPVYTAGLRGGLTPEETARLRALGAEESAVEGTSHPTA

SEQ ID NO: 47111 - protein, 373 aa, Homo sapiens
  Payload ID: 9533
  Gene Symbol: LIPT1
  Gene Name: lipoyltransferase 1
  Uniprot ID: Q9Y234
  ENSP ID: ENSP00000377114
MLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTVYHDMGNINLTFFTTKKKYDRMENLKLIVRALNAVQPQLDVQATKRFDLLLDGQFKISGTASKIGRTTAYHHCTLLCSTDGTFLSSLLKSPYQGIRSNATASIPSLVKNLLEKDPTLTCEVLMNAVATEYAAYHQIDNHIHLINPTDETLFPGINSKAKELQTWEWIYGKTPKFSINTSFHVLYEQSHLEIKVFIDIKNGRIEICNIEAPDHWLPLEIRDKLNSSLIGSKFCPTETTMLTNILLRTCPQDHKLNSKWNILCEKIKGIM

SEQ ID NO: 47112 - protein, 373 aa, Homo sapiens; identical to SEQ ID NO: 47111
  Payload ID: 9533
  Gene Symbol: LIPT1
  Gene Name: lipoyltransferase 1
  Uniprot ID: Q9Y234
  ENSP ID: ENSP00000377115

SEQ ID NO: 47113 - protein, 135 aa, Homo sapiens
  Payload ID: 9533
  Gene Symbol: LIPT1
  Gene Name: lipoyltransferase 1
  ENSP ID: ENSP00000387387
MLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTVYHDMGNINLTFFTTKKKYDRMENLKLIVR

SEQ ID NO: 47114 - protein, 251 aa, Homo sapiens
  Payload ID: 9533
  Gene Symbol: LIPT1
  Gene Name: lipoyltransferase 1
  ENSP ID: ENSP00000393591
MLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTVYHDMGNINLTFFTTKKKYDRMENLKLIVRALNAVQPQLDVQATKRFDLLLDGQFKISGTASKIGRTTAYHHCTLLCSTDGTFLSSLLKSPYQGIRSNATASIPSLVKNLLEKDPTLTCEVLMNAVATEYAAYHQIDNHIHLINPT

SEQ ID NO: 47115 - protein, 106 aa, Homo sapiens
  Payload ID: 9533
  Gene Symbol: LIPT1
  Gene Name: lipoyltransferase 1
  ENSP ID: ENSP00000398168
MLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTV

SEQ ID NO: 47116 - protein, 39 aa, Homo sapiens
  Payload ID: 9533
  Gene Symbol: LIPT1
  Gene Name: lipoyltransferase 1
  ENSP ID: ENSP00000406314
MLIPFSMKNCFQLLCNCQVPAAGFKKTVKNGLILQSISN

SEQ ID NO: 47117 - protein, 1766 aa, Homo sapiens
  Payload ID: 9534
  Gene Symbol: LTN1
  Gene Name: listerin E3 ubiquitin protein ligase 1
  Uniprot ID: O94822
  ENSP ID: ENSP00000354977
MGGKNKQRTKGNLRPSNSGRAAELLAKEQGTVPGFIGFGTSQSDLGYVPAIQGAEEIDSLVDSDFRMVLRKLSKKDVTTKLKAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSLESSAVISAFFECLRFIMQQNLGEEEIEQMLVNDQLIPFIDAVLKDPGLQHGQLFNHLAETLSSWEAKADTEKDEKTAHNLENVLIHFWERLSEICVAKISEPEADVESVLGVSNLLQVLQKPKSSLKSSKKKNGKVRFADEILESNKENEKCVSSEGEKIEGWELTTEPSLTHNSSGLLSPLRKKPLEDLVCKLADISINYVNERKSEQHLRFLSTLLDSFSSSRVFKMLLGDEKQSIVQAKPLEIAKLVQKNPAVQFLYQKLIGWLNEDQRKDFGFLVDILYSALRCCDNDMERKKVLDDLTKVDLKWNSLLKIIEKACPSSDKHALVTPWLKGDILGEKLVNLADCLCNEDLESRVSSESHFSERWTLLSLVLSQHVKNDYLIGDVYVERIIVRLHETLFKTKKLSEAESSDSSVSFICDVAYNYFSSAKGCLLMPSSEDLLLTLFQLCAQSKEKTHLPDFLICKLKNTWLSGVNLLVHQTDSSYKESTFLHLSALWLKNQVQASSLDINSLQVLLSAVDDLLNTLLESEDSYLMGVYIGSVMPNDSEWEKMRQSLPMQWLHRPLLEGRLSLNYECFKTDFKEQDIKTLPSHLCTSALLSKMVLIALRKETVLENNELEKIIAELLYSLQWCEELDNPPIFLIGFCEILQKMNITYDNLRVLGNTSGLLQLLFNRSREHGTLWSLIIAKLILSRSISSDEVKPHYKRKESFFPLTEGNLHTIQSLCPFLSKEEKKEFSAQCIPALLGWTKKDLCSTNGGFGHLAIFNSCLQTKSIDDGELLHGILKIIISWKKEHEDIFLFSCNLSEASPEVLGVNIEIIRFLSLFLKYCSSPLAESEWDFIMCSMLAWLETTSENQALYSIPLVQLFACVSCDLACDLSAFFDSTTLDTIGNLPVNLISEWKEFFSQGIHSLLLPILVTVTGENKDVSETSFQNAMLKPMCETLTYISKEQLLSHKLPARLVADQKTNLPEYLQTLLNTLAPLLLFRARPVQIAVYHMLYKLMPELPQYDQDNLKSYGDEEEEPALSPPAALMSLLSIQEDLLENVLGCIPVGQIVTIKPLSEDFCYVLGYLLTWKLILTFFKAASSQLRALYSMYLRKTKSLNKLLYHLFRLMPENPTYAETAVEVPNKDPKTFFTEELQLSIRETTMLPYHIPHLACSVYHMTLKDLPAMVRLWWNSSEKRVFNIVDRFTSKYVSSVLSFQEISSVQTSTQLFNGMTVKARATTREVMATYTIEDIVIELIIQLPSNYPLGSIIVESGKRVGVAVQQWRNWMLQLSTYLTHQNGSIMEGLALWKNNVDKRFEGVEDCMICFSVIHGFNYSLPKKACRTCKKKFHSACLYKWFTSSNKSTCPLCRETFF

SEQ ID NO: 47118 - protein, 1812 aa, Homo sapiens
  Payload ID: 9534
  Gene Symbol: LTN1
  Gene Name: listerin E3 ubiquitin protein ligase 1
  Uniprot ID: O94822
  ENSP ID: ENSP00000373846
MDRVGGGKGPGGSYYRVSSSAARSRKLCPGRVNRGLSAQSTAATATMGGKNKQRTKGNLRPSNSGRAAELLAKEQGTVPGFIGFGTSQSDLGYVPAIQGAEEIDSLVDSDFRMVLRKLSKKDVTTKLKAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSLESSAVISAFFECLRFIMQQNLGEEEIEQMLVNDQLIPFIDAVLKDPGLQHGQLFNHLAETLSSWEAKADTEKDEKTAHNLENVLIHFWERLSEICVAKISEPEADVESVLGVSNLLQVLQKPKSSLKSSKKKNGKVRFADEILESNKENEKCVSSEGEKIEGWELTTEPSLTHNSSGLLSPLRKKPLEDLVCKLADISINYVNERKSEQHLRFLSTLLDSFSSSRVFKMLLGDEKQSIVQAKPLEIAKLVQKNPAVQFLYQKLIGWLNEDQRKDFGFLVDILYSALRCCDNDMERKKVLDDLTKVDLKWNSLLKIIEKACPSSDKHALVTPWLKGDILGEKLVNLADCLCNEDLESRVSSESHFSERWTLLSLVLSQHVKNDYLIGDVYVERIIVRLHETLFKTKKLSEAESSDSSVSFICDVAYNYFSSAKGCLLMPSSEDLLLTLFQLCAQSKEKTHLPDFLICKLKNTWLSGVNLLVHQTDSSYKESTFLHLSALWLKNQVQASSLDINSLQVLLSAVDDLLNTLLESEDSYLMGVYIGSVMPNDSEWEKMRQSLPMQWLHRPLLEGRLSLNYECFKTDFKEQDIKTLPSHLCTSALLSKMVLIALRKETVLENNELEKIIAELLYSLQWCEELDNPPIFLIGFCEILQKMNITYDNLRVLGNTSGLLQLLFNRSREHGTLWSLIIAKLILSRSISSDEVKPHYKRKESFFPLTEGNLHTIQSLCPFLSKEEKKEFSAQCIPALLGWTKKDLCSTNGGFGHLAIFNSCLQTKSIDDGELLHGILKIIISWKKEHEDIFLFSCNLSEASPEVLGVNIEIIRFLSLFLKYCSSPLAESEWDFIMCSMLAWLETTSENQALYSIPLVQLFACVSCDLACDLSAFFDSTTLDTIGNLPVNLISEWKEFFSQGIHSLLLPILVTVTGENKDVSETSFQNAMLKPMCETLTYISKEQLLSHKLPARLVADQKTNLPEYLQTLLNTLAPLLLFRARPVQIAVYHMLYKLMPELPQYDQDNLKSYGDEEEEPALSPPAALMSLLSIQEDLLENVLGCIPVGQIVTIKPLSEDFCYVLGYLLTWKLILTFFKAASSQLRALYSMYLRKTKSLNKLLYHLFRLMPENPTYAETAVEVPNKDPKTFFTEELQLSIRETTMLPYHIPHLACSVYHMTLKDLPAMVRLWWNSSEKRVFNIVDRFTSKYVSSVLSFQEISSVQTSTQLFNGMTVKARATTREVMATYTIEDIVIELIIQLPSNYPLGSIIVESGKRVGVAVQQWRNWMLQLSTYLTHQNGSIMEGLALWKNNVDKRFEGVEDCMICFSVIHGFNYSLPKKACRTCKKKFHSACLYKWFTSSNKSTCPLCRETFF

SEQ ID NO: 47119 - protein, 813 aa, Homo sapiens
  Payload ID: 9534
  Gene Symbol: LTN1
  Gene Name: listerin E3 ubiquitin protein ligase 1
  ENSP ID: ENSP00000373847
MDRVGGGKGPGGSYYRVSSSAARSRKLCPGRVNRGLSAQSTAATATMGGKNKQRTKGNLRPSNSGRAAELLAKEQGTVPGFIGFGTSQSDLGYVPAIQGAEEIDSLVDSDFRMVLRKLSKKDVTTKLKAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSLESSAVISAFFECLRFIMQQNLGEEEIEQMLVNDQLIPFIDAVLKDPGLQHGQLFNHLAETLSSWEAKADTEKDEKTAHNLENVLIHFWERLSEICVAKISEPEADVESVLGVSNLLQVLQKPKSSLKSSKKKNGKVRFADEILESNKENEKCVSSEGEKIEGWELTTEPSLTHNSSGLLSPLRKKPLEDLVCKLADISINYVNERKSEQHLRFLSTLLDSFSSSRVFKMLLGDEKQSIVQAKPLEIAKLVQKNPAVQFLYQKLIGWLNEDQRKDFGFLVDILYSALRCCDNDMERKKVLDDLTKVDLKWNSLLKIIEKECTCREVQILTSVWKKILFLSSDWKFLASVCCLRFHDSLASSSPYS

SEQ ID NO: 47120 - protein, 366 aa, Homo sapiens
  Payload ID: 9534
  Gene Symbol: LTN1
  Gene Name: listerin E3 ubiquitin protein ligase 1
  ENSP ID: ENSP00000474690
  MOD_RES (1)..(1): Any amino acid
XSKKDVTTKLKAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSLESSAVISAFFECLRFIMQQNLGEEEIEQMLVNDQ

SEQ ID NO: 47121 - protein, 1812 aa, Homo sapiens; identical to SEQ ID NO: 47118
  Payload ID: 9534
  Gene Symbol: LTN1
  Gene Name: listerin E3 ubiquitin protein ligase 1
  Uniprot ID: O94822
  ENSP ID: ENSP00000478783

SEQ ID NO: 47122 - protein, 77 aa, Homo sapiens
  Payload ID: 9535
  Gene Symbol: LEAP2
  Gene Name: liver expressed antimicrobial peptide 2
  Uniprot ID: Q969E1
  ENSP ID: ENSP00000296877
MWHLKLCAVLMIFLLLLGQIDGSPIPEVSSAKRRPRRMTPFWRGVSLRPIGASCRDDSECITRLCRKRRCSLSVAQE

SEQ ID NO: 47123 - protein, 194 aa, Homo sapiens
  Payload ID: 9536
  Gene Symbol: LKAAEAR1
  Gene Name: LKAAEAR motif containing 1
  Uniprot ID: Q8TD35
  ENSP ID: ENSP00000302763
MPPPAKEGGRKGPRERSGKSAPGTAQGEERAKGAPATEPPKPGWALTPQGLAAMLPAQRHRHLLFGDLLEDVGAAASTFPCGSVEPGYRMPDPRPWTQSLELPAERQNRLLGVLKAAEARGRVRALRLRYTRMRAEEIALLIQRQKSARAAIRLELFLPPQLKPARIPDPLDRQERRRVETILEENVDGTIFPR

SEQ ID NO: 47124 - protein, 240 aa, Homo sapiens
  Payload ID: 9536
  Gene Symbol: LKAAEAR1
  Gene Name: LKAAEAR motif containing 1
  Uniprot ID: Q8TD35
  ENSP ID: ENSP00000310801
MPPPAKEGGRKGPRERSGKSAPGTAQGEERAKGAPATEPPKPGWALTPQGLAAMLPAQRHRHLLFGDLLEDVGAAASTFPCGSVEPGYRMPDPRPWTQSLELPAERQNRLLGVLKAAEARGRVRALRLRYTRMRAEEIALLIQRQKSARAAIRLELFLPPQLKPARIPDPLDRQEVQTSPGRGGERGGALPASAHAGPQPLSPAAEARGDHPGGERGWHHLPAVTATESVRRAPASHIKL

SEQ ID NO: 47125 - protein, 578 aa, Homo sapiens
  Payload ID: 9537
  Gene Symbol:
  Gene Name: LL0XNC01-16G2.1
  ENSP ID: ENSP00000488302
MLQDWCRRMGVNAERSLLILDIPDDCEEHEFQEAVRAALSPLGRYRVLIKVFRKELGARAALVEFAEGLNQSLIPRQIAGKGGPWKVISLPQALDAEFQDIPSFPAQPQGQAVARGAGEAGAAGEAGSVGEAGGVNEERSAGEDEAGGIGEAGGVGEAGAAGEAGAAGEAGAAGEAGGAGEAGGAGEAGGAGEEGGTGEEGGAGEAGGAGEEGGEDEAGAAGEAVGAGVVEAWTQSWRQTLRPLVKTMAYRELRPFSGREQPGCVEESFESWLEDAKDMLQLWCHASERERRRRLLDSLDGLALDIVSGLLEEDPDFSAQDCLTALGQVFRSRDTWMTSRMKFLTCTQGPQEGLFAFVVRLEGLLQKAVEKGAVHPAMANHLRLRQVLSRARPSEALQDTLRRMQLERRPPDFLRLLRLIRDMEAWAASLARSQQGVAWAAAPVESEDPAAAQASPAQGDASEADPGAEDADEAASTTKEAARVAPATGEDENAPAGLEGLGQGRSPDAPGGLPARMGSAVDMAPGGPSWEPEGLVQVGGQEAEEPPQEGLKPILEESENEDEDGAGEAGKPKSPPGK

SEQ ID NO: 47126 - protein, 130 aa, Homo sapiens
  Payload ID: 9538
  Gene Symbol:
  Gene Name: LLfos-48D6.2
  ENSP ID: ENSP00000481965
MVKSSLQRILNSHCFAREKEGDKPSATIHASRTMPLLSLHSRGGSSSERWPVSTAWCTWSPRPGAPKAKTTASSTTRSGPIFRTTSARHLSCSCATGRPPCSAPQPTSPPVASATRSRWWRGGTAPSMRK

SEQ ID NO: 47127 - protein, 129 aa, Homo sapiens
  Payload ID: 9539
  Gene Symbol: LLPH
  Gene Name: LLP homolog, long-term synaptic facilitation (Aplysia)
  Uniprot ID: Q9BRT6
  ENSP ID: ENSP00000266604
MAKSLRSKWKRKMRAEKRKKNAPKEASRLKSILKLDGDVLMKDVQEIATVVVPKPKHCQEKMQCEVKDEKDDMKMETDIKRNKKTLLDQHGQYPIWMNQRQRKRLKAKREKRKGKSKAKAVKVAKGLAW

SEQ ID NO: 47128 - protein, 129 aa, Homo sapiens; identical to SEQ ID NO: 47127
  Payload ID: 9539
  Gene Symbol: LLPH
  Gene Name: LLP homolog, long-term synaptic facilitation (Aplysia)
  Uniprot ID: Q9BRT6
  ENSP ID: ENSP00000437372

SEQ ID NO: 47129 - protein, 467 aa, Homo sapiens
  Payload ID: 9540
  Gene Symbol: LMBRD1
  Gene Name: LMBR1 domain containing 1
  Uniprot ID: Q9NUN5
  ENSP ID: ENSP00000359602
MKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNITSDNHKGNSTLSVPKRCDADAPEDQCTVTRTYLFLHKFWFFSAAYYFGNWAFLGVFLIGLIVSCCKGKKSVIEGVDEDSDISDDEPSVYSA

SEQ ID NO: 47130 - protein, 540 aa, Homo sapiens
  Payload ID: 9540
  Gene Symbol: LMBRD1
  Gene Name: LMBR1 domain containing 1
  Uniprot ID: Q9NUN5
  ENSP ID: ENSP00000359609
MATSGAASAELVIGWCIFGLLLLAILAFCWIYVRKYQSRRESEVVSTITAIFSLAIALITSALLPVDIFLVSYMKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNITSDNHKGNSTLSVPKRCDADAPEDQCTVTRTYLFLHKFWFFSAAYYFGNWAFLGVFLIGLIVSCCKGKKSVIEGVDEDSDISDDEPSVYSA

SEQ ID NO: 47131 - protein, 392 aa, Homo sapiens
  Payload ID: 9540
  Gene Symbol: LMBRD1
  Gene Name: LMBR1 domain containing 1
  Uniprot ID: Q9NUN5
  ENSP ID: ENSP00000433385
MATSGAASAELVIGWCIFGLLLLAILAFCWIYVRKYQSRRESEVVSTITAIFSLAIALITSALLPVDIFLVSYMKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTEFEILAYGSFGLDYIKSEEVEPGPKHSFFSA

SEQ ID NO: 47132 - protein, 695 aa, Homo sapiens
  Payload ID: 9541
  Gene Symbol: LMBRD2
  Gene Name: LMBR1 domain containing 2
  Uniprot ID: Q68DH5
  ENSP ID: ENSP00000296603
MSGAALGLEIVFVFFLALFLLHRYGDFKKQHRLVIIGTLLAWYLCFLIVFILPLDVSTTIYNRCKHAAANSSPPENSNITGLYATANPVPSQHPCFKPWSYIPDGIMPIFWRVVYWTSQFLTWILLPFMQSYARSGGFSITGKIKTALIENAIYYGTYLLIFGAFLIYVAVNPHLHLEWNQLQTIGIAAANTWGLFLLVLLLGYGLVEIPRSYWNGAKRGYLLMKTYFKAAKLMTEKADAEENLEDAMEEVRKVNESIKYNHPLRKCVDTILKKCPTEYQEKMGRNMDDYEDFDEKHSIYPSEKSLVKLHKQVIYSVQRHRRTQVQWQILLEQAFYLEDVAKNETSATHQFVHTFQSPEPENRFIQYFYNPTFEWYWECLLRPWFYKILAVVLSIFSVIVVWSECTFFSTTPVLSLFAVFIQLAEKTYNYIYIEIACFLSIFFLSICVYSTVFRIRVFNYYYLASHHQTDAYSLLFSGMLFCRLTPPLCLNFLGLTHMDSSISHKNTQPTAYTSIMGSMKVLSFIADGFYIYYPMLVVILCIATYFSLGTRCLNLLGFQQFMGDDDMTSDLVNEGKELIRKEKRKRQRQEEGENRRREWKERYGHNREDSTRNRNIHTDPKESNFSDVNTNRSAFKYTRANNRTERDRIELLQDAEPLDFNAETFTDDPLESESGRYQPGGRYLSMSRSDIFNDV

SEQ ID NO: 47133 - protein, 122 aa, Homo sapiens
  Payload ID: 9542
  Gene Symbol: LMO7DN
  Gene Name: LMO7 downstream neighbor
  Uniprot ID: F2Z398
  ENSP ID: ENSP00000317235
MTWLDKGVWTQEDENSCSFSESDFPGCRDQINPSIPSIWTAVSGMMISLEVRWWIKGKQGYVISLGHALSPRLECSGTFSAHCILGLPGGSSYPPASVSQVVGTTALYLVEEAWAEAGKMRS

SEQ ID NO: 47134 - protein, 959 aa, Homo sapiens
  Payload ID: 9543
  Gene Symbol: LONP1
  Gene Name: lon peptidase 1, mitochondrial
  Uniprot ID: P36776
  ENSP ID: ENSP00000353826
MAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 47135 - protein, 763 aa, Homo sapiens
  Payload ID: 9543
  Gene Symbol: LONP1
  Gene Name: lon peptidase 1, mitochondrial
  Uniprot ID: P36776
  ENSP ID: ENSP00000441523
MQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 47136 - protein, 829 aa, Homo sapiens
  Payload ID: 9543
  Gene Symbol: LONP1
  Gene Name: lon peptidase 1, mitochondrial
  ENSP ID: ENSP00000465139
MTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 47137 - protein, 845 aa, Homo sapiens
  Payload ID: 9543
  Gene Symbol: LONP1
  Gene Name: lon peptidase 1, mitochondrial
  ENSP ID: ENSP00000465585
MTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 47138 - protein, 185 aa, Homo sapiens
  Payload ID: 9543
  Gene Symbol: LONP1
  Gene Name: lon peptidase 1, mitochondrial
  ENSP ID: ENSP00000467808
GGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRREASAGSSSQPQRLIHTCLAPVSESISADSWRWSPRSRRRRTSTSPAGSQSGARRRRRTS

SEQ ID NO: 47139 - protein, 242 aa, Homo sapiens
  Payload ID: 9543
  Gene Symbol: LONP1
  Gene Name: lon peptidase 1, mitochondrial
  ENSP ID: ENSP00000468083
  MOD_RES (1)..(1): Any amino acid
XMMQAGQRVVDNPIYLSDMGAALTGAESHELQDVLEETNVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENP

SEQ ID NO: 47140 - protein, 210 aa, Homo sapiens
  Payload ID: 9543
  Gene Symbol: LONP1
  Gene Name: lon peptidase 1, mitochondrial
  ENSP ID: ENSP00000468114
MAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVEEQLKIIKKELGLEKDDKDAIEEKFRERLKELVVPKHVMDVVDEELSKLGLLDNHSSEFNVTRNYL

SEQ ID NO: 47141 - protein, 264 aa, Homo sapiens
  Payload ID: 9543
  Gene Symbol: LONP1
  Gene Name: lon peptidase 1, mitochondrial
  ENSP ID: ENSP00000468379
RKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAQAGLTLTLPPGQARRGDVHRPASREQEGLLRPGSLHHRGPGGALRGTLPGDLRHRLPGRAGRGAGRGTVTATPGLQAADVRP

SEQ ID NO: 47142 - protein, 86 aa, Homo sapiens
  Payload ID: 9543
  Gene Symbol: LONP1
  Gene Name: lon peptidase 1, mitochondrial
  ENSP ID: ENSP00000468385
MAASTGYVRLWGAARCWVLRRPMLAAAGGRVPTAAGAWLLRGQRTCDASPPWALWGRGPAIGGQWRGTSTSPAGSQSGARRRRRTS

SEQ ID NO: 47143 - protein, 895 aa, Homo sapiens
  Payload ID: 9543
  Gene Symbol: LONP1
  Gene Name: lon peptidase 1, mitochondrial
  Uniprot ID: P36776
  ENSP ID: ENSP00000468541
MAASTGYVRLWGAARCWVLRRPMLAAAGGRVPTAAGAWLLRGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 47144 - protein, 852 aa, Homo sapiens
  Payload ID: 9544
  Gene Symbol: LONP2
  Gene Name: lon peptidase 2, peroxisomal
  Uniprot ID: Q86WA8
  ENSP ID: ENSP00000285737
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQLVEMLDMSVPAVAKLRRLLDSLPREALPDILTSIIRTSNKEKLQILDAVSLEERFKMTIPLLVRQIEGLKLLQKTRKPKQDDDKRVIAIRPIRRITHISGTLEDEDEDEDNDDIVMLEKKIRTSSMPEQAHKVCVKEIKRLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLEVLDPEQNHNFTDHYLNVAFDLSQVLFIATANTTATIPAALLDRMEIIQVPGYTQEEKIEIAHRHLIPKQLEQHGLTPQQIQIPQVTTLDIITRYTREAGVRSLDRKLGAICRAVAVKVAEGQHKEAKLDRSDVTEREGCREHILEDEKPESISDTTDLALPPEMPILIDFHALKDILGPPMYEMEVSQRLSQPGVAIGLAWTPLGGEIMFVEASRMDGEGQLTLTGQLGDVMKESAHLAISWLRSNAKKYQLTNAFGSFDLLDNTDIHLHFPAGAVTKDGPSAGVTIVTCLASLFSGRLVRSDVAMTGEITLRGLVLPVGGIKDKVLAAHRAGLKQVIIPRRNEKDLEGIPGNVRQDLSFVTASCLDEVLNAAFDGGFTVKTRPGLLNSKL

SEQ ID NO: 47145 - protein, 605 aa, Homo sapiens
  Payload ID: 9544
  Gene Symbol: LONP2
  Gene Name: lon peptidase 2, peroxisomal
  ENSP ID: ENSP00000415983
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQILDAVSLEERFKMTIPLLVRQIEGLKLLQKTRKPKQDDDKRVIAIRPIRRITHISGTLEDEDEDEDNDDIVMLEKKIRTSSMPEQAHKVCVKEIKRLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLEVLDPEQNHNFTDHYLNVAFDLSQVLFIATANTTATIPAALLDRMEIIQVPGYTQEEKIEIAHRHLIPKQLEQHGLTPQQIQIPQVTTLDIITRYTREAGVRSLDRKLGAICRAVAVKVAEGQHKEAKLDRSDVTEREGCREHILEDEKPESISDTTDLALPPEMPILIDFHALKDILGPPMYEMEIAS

SEQ ID NO: 47146 - protein, 808 aa, Homo sapiens
  Payload ID: 9544
  Gene Symbol: LONP2
  Gene Name: lon peptidase 2, peroxisomal
  Uniprot ID: Q86WA8
  ENSP ID: ENSP00000445426
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQILDAVSLEERFKMTIPLLVRQIEGLKLLQKTRKPKQDDDKRVIAIRPIRRITHISGTLEDEDEDEDNDDIVMLEKKIRTSSMPEQAHKVCVKEIKRLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLEVLDPEQNHNFTDHYLNVAFDLSQVLFIATANTTATIPAALLDRMEIIQVPGYTQEEKIEIAHRHLIPKQLEQHGLTPQQIQIPQVTTLDIITRYTREAGVRSLDRKLGAICRAVAVKVAEGQHKEAKLDRSDVTEREGCREHILEDEKPESISDTTDLALPPEMPILIDFHALKDILGPPMYEMEVSQRLSQPGVAIGLAWTPLGGEIMFVEASRMDGEGQLTLTGQLGDVMKESAHLAISWLRSNAKKYQLTNAFGSFDLLDNTDIHLHFPAGAVTKDGPSAGVTIVTCLASLFSGRLVRSDVAMTGEITLRGLVLPVGGIKDKVLAAHRAGLKQVIIPRRNEKDLEGIPGNVRQDLSFVTASCLDEVLNAAFDGGFTVKTRPGLLNSKL

SEQ ID NO: 47147 - protein, 236 aa, Homo sapiens
  Payload ID: 9544
  Gene Symbol: LONP2
  Gene Name: lon peptidase 2, peroxisomal
  ENSP ID: ENSP00000455297
  MOD_RES (1)..(1): Any amino acid
XHALKDILGPPMYEMEVSQRLSQPGVAIGLAWTPLGGEIMFVEASRMDGEGQLTLTGQLGDVMKESAHLAISWLRSNAKKYQLTNAFGSFDLLDNTDIHLHFPAGAVTKDGPSAGVTIVTCLASLFSGRLVRSDVAMTGEITLRGLVLPVGGIKDKVLAAHRAGLKQVIIPRRNEKDLEGIPGNIEESLPKSIVAYDHLAQVGKQNFQLACVFLSAVRLRRTAGDHRIFPVSLRLT

SEQ ID NO: 47148 - protein, 169 aa, Homo sapiens
  Payload ID: 9544
  Gene Symbol: LONP2
  Gene Name: lon peptidase 2, peroxisomal
  ENSP ID: ENSP00000455633
RLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLEFFL

SEQ ID NO: 47149 - protein, 300 aa, Homo sapiens
  Payload ID: 9544
  Gene Symbol: LONP2
  Gene Name: lon peptidase 2, peroxisomal
  ENSP ID: ENSP00000457841
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQLVEMLDMSVPAVAKLRRLLDSLPREALPDILTSIIRTSNKEKLQILDAVSLEERFKMTIPLLVRQIEGLKLLQKTRKPKQDDDKRVIAIRPIRRITHISGTLEDEDEDEDNDDIVMLEKKIRTSSMPEQAHKVCVKEIKRPPGH

SEQ ID NO: 47150 - protein, 773 aa, Homo sapiens
  Payload ID: 9545
  Gene Symbol: LONRF1
  Gene Name: LON peptidase N-terminal domain and ring finger 1
  Uniprot ID: Q17RB8
  ENSP ID: ENSP00000381298
MSSPAVARTSPGGSREMAPAPQGRGRFWEVGGGSGHRLERAAAESERWELLLRRGELLALGGHLKGALEAFAAALRRGAPARPECLGALVDCLVFNYRLRHGLGWSAAPVAGADGGAGGLLRCLGCRGFLSEPVTVPCGHSYCRRCLRRELRARCRLCRDRLPPATASATDAEGTAPRPPPLAAAIAASDFRTSVVLNHLAEKWFPGQRERARAAGRLGELLHQGRYREALAAACEALRAEPSDLIVKIYRAESYAGLQEFKAAIEDLNAVLFQLPDWPEVYFRKGKVLCDAGFLGDALQLFLQCLALDEDFAPAKLQVQKILCDLLLPENLKEGLKESSWSSLPCTKNRPFDFHSVMEESQSLNEPSPKQSEEIPEVTSEPVKGSLNRAQSAQSINSTEMPAREDCLKRVSSEPVLSVQEKGVLLKRKLSLLEQDVIVNEDGRNKLKKQGETPNEVCMFSLAYGDIPEELIDVSDFECSLCMRLFFEPVTTPCGHSFCKNCLERCLDHAPYCPLCKESLKEYLADRRYCVTQLLEELIVKYLPDELSERKKIYDEETAELSHLTKNVPIFVCTMAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPEREENLQAAPNGPAWCWWLLAVLPVDPRYQLSVLSMKSLKERLTKIQHILTYFSRDQSK

SEQ ID NO: 47151 - protein, 416 aa, Homo sapiens
  Payload ID: 9545
  Gene Symbol: LONRF1
  Gene Name: LON peptidase N-terminal domain and ring finger 1
  ENSP ID: ENSP00000432130
MEESQSLNEPSPKQSEEIPEVTSEPVKGSLNRAQSAQSINSTEMPAREDCLKRVSSEPVLSVQEKGVLLKRKLSLLEQDVIVNEDGRNKLKKQGETPNEVCMFSLAYGDIPEELIDVSDFECSLCMRLFFEPVTTPCGHSFCKNCLERCLDHAPYCPLCKESLKEYLADRRYCVTQLLEELIVKYLPDELSERKKIYDEETAELSHLTKNVPIFVCTMAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPEREENLQAAPNGPAWCWWLLAVLPVDPRYQLSVLSMKSLKERLTKIQHILTYFSRDQSK

SEQ ID NO: 47152 - protein, 376 aa, Homo sapiens
  Payload ID: 9545
  Gene Symbol: LONRF1
  Gene Name: LON peptidase N-terminal domain and ring finger 1
  ENSP ID: ENSP00000433327
LNRAQSAQSINSTEMPAREDCLKRVSSEPVLSVQEKGVLLKRKLSLLEQDVIVNEDGRNKLKKQGAYGDIPEELIDVSDFECSLCMRLFFEPVTTPCGHSFCKNCLERCLDHAPYCPLCKESLKEYLADRRYCVTQLLEELIVKYLPDELSERKKIYDEETAELSHLTKNVPIFVCTMAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPEREENLQAAPNGPAWCWWLLAVLPVDPRYQLSVLSMKSLKERLTKIQHILTYFSRDQSK

SEQ ID NO: 47153 - protein, 59 aa, Homo sapiens
  Payload ID: 9545
  Gene Symbol: LONRF1
  Gene Name: LON peptidase N-terminal domain and ring finger 1
  ENSP ID: ENSP00000434090
MEESQSLNEPSPKQLDEPTDAEPVDTEGQLCWQKSFTCHSVGIKVKKYQRSLQSLSKEA

SEQ ID NO: 47154 - protein, 199 aa, Homo sapiens
  Payload ID: 9545
  Gene Symbol: LONRF1
  Gene Name: LON peptidase N-terminal domain and ring finger 1
  ENSP ID: ENSP00000436770
MAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPEREENLQAAPNGPAWCWWLLAVLPVDPRYQLSVLSMKSLKERLTKIQHILTYFSRDQSK

SEQ ID NO: 47155 - protein, 59 aa, Homo sapiens; identical to SEQ ID NO: 47153
  Payload ID: 9545
  Gene Symbol: LONRF1
  Gene Name: LON peptidase N-terminal domain and ring finger 1
  ENSP ID: ENSP00000451692

SEQ ID NO: 47156 - protein, 754 aa, Homo sapiens
  Payload ID: 9546
  Gene Symbol: LONRF2
  Gene Name: LON peptidase N-terminal domain and ring finger 2
  Uniprot ID: Q1L5Z9
  ENSP ID: ENSP00000377086
MSPEPVPPPPPPQCPGCDRAEPIAQRLEEGDEAFRAGDYEMAAELFRSMLAGLAQPDRGLCLRLGDALARAGRLPEALGAFRGAARLGALRPEELEELAGGLVRAVGLRDRPLSAENPGGEPEAPGEGGPAPEPRAPRDLLGCPRCRRLLHKPVTLPCGLTVCKRCVEPGPARPQVRRVNVVLSGLLEKCFPAECRLRRLAGQARSLQRQQQPEAALLRCDQALELAPDDNSLLLLRAELYLTMKNYEQALQDASAACQNEPLLIKGHQVKAQALSGLGRSKEVLKEFLYCLALNPECNSVKKEAQKVMCEVLFSATANVHENLTSSIQSRLKAQGHSHMNAQALLEEGDAGSSENSSEKSDMLGNTNSSVLYFILGLHFEEDKKALESILPTAPSAGLKRQFPDDVEDAPDLNAPGKIPKKDLSLQRSPNSETEESQGLSLDVTDFECALCMRLLFEPVTTPCGHTFCLKCLERCLDHAPHCPLCKDKLSELLASRNFNITVLAEELIFRYLPDELSDRKRIYDEEMSELSNLTRDVPIFVCAMAFPTVPCPLHVFEPRYRLMIRRCMETGTKRFGMCLSAEHAGLSEYGCMLEIKDVRTFPDGSSVVDAIGISRFRVLSHRHRDGYNTADIEYLEDEKVEGPEYEELAALHDSVHQQSVSWFASLQDRMKEQILSHFGVMPDREPEPQSNPSGPAWSWWILAVLPLERKAQLAILGMTSLKERLLAIRRILVIITRKMNSRQELANARERNN

SEQ ID NO: 47157 - protein, 511 aa, Homo sapiens
  Payload ID: 9546
  Gene Symbol: LONRF2
  Gene Name: LON peptidase N-terminal domain and ring finger 2
  Uniprot ID: Q1L5Z9
  ENSP ID: ENSP00000386823
MKNYEQALQDASAACQNEPLLIKGHQVKAQALSGLGRSKEVLKEFLYCLALNPECNSVKKEAQKVMCEVLFSATANVHENLTSSIQSRLKAQGHSHMNAQALLEEGDAGSSENSSEKSDMLGNTNSSVLYFILGLHFEEDKKALESILPTAPSAGLKRQFPDDVEDAPDLNAPGKIPKKDLSLQRSPNSETEESQGLSLDVTDFECALCMRLLFEPVTTPCGHTFCLKCLERCLDHAPHCPLCKDKLSELLASRNFNITVLAEELIFRYLPDELSDRKRIYDEEMSELSNLTRDVPIFVCAMAFPTVPCPLHVFEPRYRLMIRRCMETGTKRFGMCLSAEHAGLSEYGCMLEIKDVRTFPDGSSVVDAIGISRFRVLSHRHRDGYNTADIEYLEDEKVEGPEYEELAALHDSVHQQSVSWFASLQDRMKEQILSHFGVMPDREPEPQSNPSGPAWSWWILAVLPLERKAQLAILGMTSLKERLLAIRRILVIITRKMNSRQELANARERNN

SEQ ID NO: 47158 - protein, 718 aa, Homo sapiens
  Payload ID: 9547
  Gene Symbol: LONRF3
  Gene Name: LON peptidase N-terminal domain and ring finger 3
  Uniprot ID: Q496Y0
  ENSP ID: ENSP00000307732
MESVRIEQMLSLPAEVSSDNLESAERGASAAQVDMGPHPKVAAEGPAPLPTREPEQEQSPGTSTPESKVLLTQADALASRGRIREALEVYRQLSERQQLVAEQLEQLVRCLAEKVPQGEALAPAPPDEGSTASGTVAAEETGAAAAAAATEVWDGFKCRKCHGFLSDPVSLSCGHTFCKLCLERGRAADRRCALCGVKLSALMVATGRARGARRAGQQPPPPLRVNVVLSGLLGKLFPGPARASQLRHEGNRLYRERQVEAALLKYNEAVKLAPNDHLLYSNRSQIYFTLESHENALHDAEIACKLRPMGFKDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGFAEYGCILEIRNVQFFADGRSVVDSIGKRRFRVLHQSQRDGYNTADIEYIEDQKVQGEDCAELMGLHNCVYQQASLWFHSLKLSLKNRILNHFGPMPEKDADPQMNPNGPAWCWWMLAVLPLESRAQLPFLAMRSLKDRLNGIRRVLAFISRNQN

SEQ ID NO: 47159 - protein, 759 aa, Homo sapiens
  Payload ID: 9547
  Gene Symbol: LONRF3
  Gene Name: LON peptidase N-terminal domain and ring finger 3
  Uniprot ID: Q496Y0
  ENSP ID: ENSP00000360690
MESVRIEQMLSLPAEVSSDNLESAERGASAAQVDMGPHPKVAAEGPAPLPTREPEQEQSPGTSTPESKVLLTQADALASRGRIREALEVYRQLSERQQLVAEQLEQLVRCLAEKVPQGEALAPAPPDEGSTASGTVAAEETGAAAAAAATEVWDGFKCRKCHGFLSDPVSLSCGHTFCKLCLERGRAADRRCALCGVKLSALMVATGRARGARRAGQQPPPPLRVNVVLSGLLGKLFPGPARASQLRHEGNRLYRERQVEAALLKYNEAVKLAPNDHLLYSNRSQIYFTLESHENALHDAEIACKLRPMGFKAHFRKAQALATLGKVEEALREFLYCVSLDGKNKRARCEAQRDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGFAEYGCILEIRNVQFFADGRSVVDSIGKRRFRVLHQSQRDGYNTADIEYIEDQKVQGEDCAELMGLHNCVYQQASLWFHSLKLSLKNRILNHFGPMPEKDADPQMNPNGPAWCWWMLAVLPLESRAQLPFLAMRSLKDRLNGIRRVLAFISRNQN

SEQ ID NO: 47160 - protein, 503 aa, Homo sapiens
  Payload ID: 9547
  Gene Symbol: LONRF3
  Gene Name: LON peptidase N-terminal domain and ring finger 3
  ENSP ID: ENSP00000408894
MGFKAHFRKAQALATLGKVEEALREFLYCVSLDGKNKRARCEAQRLLLSFFSPSVPGDSQEHSPDILKLLAPHPRLKENVESMTTEVTSHNLPRLLQDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGFAEYGCILEIRNVQFFADGRSVVDSIGKRRFRVLHQSQRDGYNTADIEYIEDQKVQGEDCAELMGLHNCVYQQASLWFHSLKLSLKNRILNHFGPMPEKDADPQMNPNGPAWCWWMLAVLPLESRAQLPFLAMRSLKDRLNGIRRVLAFISRNQN

SEQ ID NO: 47161 - protein, 525 aa, Homo sapiens
  Payload ID: 9547
  Gene Symbol: LONRF3
  Gene Name: LON peptidase N-terminal domain and ring finger 3
  ENSP ID: ENSP00000414519
  MOD_RES (1)..(1): Any amino acid
XCGVKLSALMVATGRARGARRAGQQPPPPLRVNVVLSGLLGKLFPGPARASQLRHEGNRLYRERQVEAALLKYNEAVKLAPNDHLLYSNRSQIYFTLESHENALHDAEIACKLRPMGFKDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGFAEYGCILEIRNVQFFADGRSVVDSIGKRRFRVLHQSQRDGYNTADIEYIEDQKVQGEDCAELMGLHNCVYQQASLWFHSLKLSLKNRILNHFGPMPEKDADPQMNPNGPAWCWWMLAVLPLESRAQLPFLAMRSLKDRLNGIRRVLAFISRNQN

SEQ ID NO: 47162 - protein, 610 aa, Homo sapiens
  Payload ID: 9547
  Gene Symbol: LONRF3
  Gene Name: LON peptidase N-terminal domain and ring finger 3
  Uniprot ID: Q496Y0
  ENSP ID: ENSP00000435426
MESVRIEQMLSLPAEVSSDNLESAERGASAAQVDMGPHPKVAAEGPAPLPTREPEQEQSPGTSTPESKVLLTQADALASRGRIREALEVYRQLSERQQLVAEQLEQLVRCLAEKVPQGEALAPAPPDEGSTASGTVAAEETGAAAAAAATEVWDGFKCRKCHGFLSDPVSLSCGHTFCKLCLERGRAADRRCALCGVKLSALMVATGRARGARRAGQQPPPPLRVNVVLSGLLGKLFPGPARASQLRHEGNRLYRERQVEAALLKYNEAVKLAPNDHLLYSNRSQIYFTLESHENALHDAEIACKLRPMGFKAHFRKAQALATLGKVEEALREFLYCVSLDGKNKRARCEAQRDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGHCLLCN

SEQ ID NO: 47163 - protein, 56 aa, Homo sapiens
  Payload ID: 9548
  Gene Symbol: LINC00116
  Gene Name: long intergenic non-protein coding RNA 116
  Uniprot ID: Q8NCU8
  ENSP ID: ENSP00000485064
MADVSERTLQLSVLVAFASGVLLGWQANRLRRRYLDWRKRRLQDKLAATQKKLDLA

SEQ ID NO: 47164 - protein, 138 aa, Homo sapiens
  Payload ID: 9548
  Gene Symbol: LINC00116
  Gene Name: long intergenic non-protein coding RNA 116
  Uniprot ID: Q8NCU8
  ENSP ID: ENSP00000485216
MLANDVRHQQEMWGFRKVEGGVVQSLGKSSVEGETDGTISEFREIQRLAAFASFLSHAPPLNARRLLTPPPRRRPRCTPAAAMADVSERTLQLSVLVAFASGVLLGWQANRLRRRYLDWRKRRLQDKLAATQKKLDLA

SEQ ID NO: 47165 - protein, 56 aa, Homo sapiens; identical to SEQ ID NO: 47163
  Payload ID: 9548
  Gene Symbol: LINC00116
  Gene Name: long intergenic non-protein coding RNA 116
  Uniprot ID: Q8NCU8
  ENSP ID: ENSP00000485373

SEQ ID NO: 47166 - protein, 40 aa, Homo sapiens
  Payload ID: 9549
  Gene Symbol: LINC01420
  Gene Name: long intergenic non-protein coding RNA 1420
  ENSP ID: ENSP00000489367
  MOD_RES (1)..(1): Any amino acid
XSGRSTLPPGNAREAKPPKKRCLLAPRWDYPEGTPNGVFE

SEQ ID NO: 47167 - protein, 68 aa, Homo sapiens
  Payload ID: 9549
  Gene Symbol: LINC01420
  Gene Name: long intergenic non-protein coding RNA 1420
  ENSP ID: ENSP00000489486
MGDQPCASGRSTLPPGNAREAKPPKKRCLLAPRWDYPEGTPNGGSTTLPSAPPPASAGLKSHPPPPEK

SEQ ID NO: 47168 - protein, 68 aa, Homo sapiens; identical to SEQ ID NO: 47167
  Payload ID: 9549
  Gene Symbol: LINC01420
  Gene Name: long intergenic non-protein coding RNA 1420
  ENSP ID: ENSP00000489583

SEQ ID NO: 47169 - protein, 62 aa, Homo sapiens
  Payload ID: 9550
  Gene Symbol: LINC01556
  Gene Name: long intergenic non-protein coding RNA 1556
  Uniprot ID: Q5JQF7
  ENSP ID: ENSP00000373152
MLQVVQEGNPAPFIINTVKRGRRDRERQRTPWAPHPLGFQGRRYIYESPNHRGKDSSFLAQK

SEQ ID NO: 47170 - protein, 62 aa, Homo sapiens
  Payload ID: 9550
  Gene Symbol: LINC01556
  Gene Name: long intergenic non-protein coding RNA 1556
  Uniprot ID: Q5JQF7
  ENSP ID: ENSP00000394134
MLQVVQEGNPAPFIINTVKRGRRDRERQRTPWAPHPLGFQERRYIYESPNHRGKDSSFLAQK

SEQ ID NO: 47171 - protein, 62 aa, Homo sapiens; identical to SEQ ID NO: 47170
  Payload ID: 9550
  Gene Symbol: LINC01556
  Gene Name: long intergenic non-protein coding RNA 1556
  Uniprot ID: Q5JQF7
  ENSP ID: ENSP00000396675

SEQ ID NO: 47172 - protein, 62 aa, Homo sapiens; identical to SEQ ID NO: 47170
  Payload ID: 9550
  Gene Symbol: LINC01556
  Gene Name: long intergenic non-protein coding RNA 1556
  Uniprot ID: Q5JQF7
  ENSP ID: ENSP00000401725

SEQ ID NO: 47173 - protein, 62 aa, Homo sapiens; identical to SEQ ID NO: 47169
  Payload ID: 9550
  Gene Symbol: LINC01556
  Gene Name: long intergenic non-protein coding RNA 1556
  Uniprot ID: Q5JQF7
  ENSP ID: ENSP00000410635

SEQ ID NO: 47174 - protein, 170 aa, Homo sapiens
  Payload ID: 9551
  Gene Symbol: LINC01620
  Gene Name: long intergenic non-protein coding RNA 1620
  Uniprot ID: Q4KN68
  ENSP ID: ENSP00000362001
MAYYFHFYGELPSQESPHPGVYSPHPQGGWQPTADSYREWHNEDLNPRMSHWTYAQELVSYKKTSFIVWRHRISPNGVTSRKPYCHFHGGQWPGPTPPSCLSSAFASGSFSHFEDSPYILLHVVLQMCWLRAQRLNQRDLGLNPTSAIEHQLSDLDCVPLLLWASDSPSE

SEQ ID NO: 47175 - protein, 95 aa, Homo sapiens
  Payload ID: 9552
  Gene Symbol: LINC00493
  Gene Name: long intergenic non-protein coding RNA 493
  ENSP ID: ENSP00000485316
MYRNEFTAWYRRMSVVYGIGTWSVLGSLLYYSRTMAKSSVDQKDGSASEVPSELSERPKGFYVETVVTYKEDFVPNTEKILNYWKSWTGGPGTEP

SEQ ID NO: 47176 - protein, 94 aa, Homo sapiens
  Payload ID: 9552
  Gene Symbol: LINC00493
  Gene Name: long intergenic non-protein coding RNA 493
  ENSP ID: ENSP00000485491
MYRNEFTAWYRRMSVVYGIGTWSVLGSLLYYSRTMAKSSDQKDGSASEVPSELSERPKGFYVETVVTYKEDFVPNTEKILNYWKSWTGGPGTEP

SEQ ID NO: 47177 - protein, 73 aa, Homo sapiens
  Payload ID: 9552
  Gene Symbol: LINC00493
  Gene Name: long intergenic non-protein coding RNA 493
  ENSP ID: ENSP00000485501
MYRNEFTAWYRRMSVVYGIGTWSVLGSLLYYSRTMAKSSGLTLSPRLECSGMISAHHNLRLRAQVILLPQPPE

SEQ ID NO: 47178 - protein, 101 aa, Homo sapiens
  Payload ID: 9553
  Gene Symbol: LINC00694
  Gene Name: long intergenic non-protein coding RNA 694
  Uniprot ID: P0DN24
  ENSP ID: ENSP00000489112
MSRGQFGQGQEPLDMFFWVNEISGEITYPPQKADAPAVSPESPQKKPPFQPRSVQEAPCSPQGPPAQRPALAPPSKPSLKDSGSRNPCPSAPTWARPKPEE

SEQ ID NO: 47179 - protein, 101 aa, Homo sapiens; identical to SEQ ID NO: 47178
  Payload ID: 9553
  Gene Symbol: LINC00694
  Gene Name: long intergenic non-protein coding RNA 694
  Uniprot ID: P0DN24
  ENSP ID: ENSP00000489511

SEQ ID NO: 47180 - protein, 667 aa, Homo sapiens
  Payload ID: 9554
  Gene Symbol:
  Gene Name: Long-chain-fatty-acid--CoA ligase 6  [Source:UniProtKB/Swiss-Prot
  Acc:Q9UKU0]
  Uniprot ID: Q9UKU0
  ENSP ID: ENSP00000415140
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQDLPQCLIQIKVFSKY

SEQ ID NO: 47181 - protein, 312 aa, Homo sapiens
  Payload ID: 9555
  Gene Symbol: LOR
  Gene Name: loricrin
  Uniprot ID: P23490
  ENSP ID: ENSP00000357731
MSYQKKQPTPQPPVDCVKTSGGGGGGGGSGGGGCGFFGGGGSGGGSSGSGCGYSGGGGYSGGGCGGGSSGGGGGGGIGGCGGGSGGSVKYSGGGGSSGGGSGCFSSGGGGSGCFSSGGGGSSGGGSGCFSSGGGGSSGGGSGCFSSGGGGFSGQAVQCQSYGGVSSGGSSGGGSGCFSSGGGGGSVCGYSGGGSGCGGGSSGGSGSGYVSSQQVTQTSCAPQPSYGGGSSGGGGSGGSGCFSSGGGGGSSGCGGGSSGIGSGCIISGGGSVCGGGSSGGGGGGSSVGGSGSGKGVPICHQTQQKQAPTWPSK

SEQ ID NO: 47182 - protein, 945 aa, Homo sapiens
  Payload ID: 9556
  Gene Symbol: LDLR
  Gene Name: low density lipoprotein receptor
  ENSP ID: ENSP00000252444
  MOD_RES (1)..(1): Any amino acid
XGRPGVPPRFLSQRRRQVPGPRSRLRDIHESPSVILGPPGEVPGFRCALWRHLRPHLVLGGALAPPAPIKFTEGPPATLKASVPYEVETLPQNLPAPPWSAAEIFSHVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 47183 - protein, 692 aa, Homo sapiens
  Payload ID: 9556
  Gene Symbol: LDLR
  Gene Name: low density lipoprotein receptor
  Uniprot ID: P01130
  ENSP ID: ENSP00000397829
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCLTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 47184 - protein, 682 aa, Homo sapiens
  Payload ID: 9556
  Gene Symbol: LDLR
  Gene Name: low density lipoprotein receptor
  Uniprot ID: P01130
  ENSP ID: ENSP00000437639
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPREAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 47185 - protein, 819 aa, Homo sapiens
  Payload ID: 9556
  Gene Symbol: LDLR
  Gene Name: low density lipoprotein receptor
  Uniprot ID: P01130
  ENSP ID: ENSP00000440520
MGPWGWKLRWTVALLLAAAGTAVGDRCERNEFQCQDGKCISYKWVCDGSAECQDGSDESQETCSPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 47186 - protein, 858 aa, Homo sapiens
  Payload ID: 9556
  Gene Symbol: LDLR
  Gene Name: low density lipoprotein receptor
  Uniprot ID: P01130
  ENSP ID: ENSP00000453346
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSMVSLEDDVA

SEQ ID NO: 47187 - protein, 309 aa, Homo sapiens
  Payload ID: 9556
  Gene Symbol: LDLR
  Gene Name: low density lipoprotein receptor
  ENSP ID: ENSP00000453513
  MOD_RES (1)..(1): Any amino acid
XLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVD

SEQ ID NO: 47188 - protein, 948 aa, Homo sapiens
  Payload ID: 9556
  Gene Symbol: LDLR
  Gene Name: low density lipoprotein receptor
  ENSP ID: ENSP00000453557
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIATELGLWSRGQLCDRACLSLQCSSSSFAWGSSFYGRTGGLRTSTASTLTTPSIRRPQRMRSTFATTRTATATPRDRWSVWRMTWREHLPGVPSLPRTLPETSPALFYSKTEKTKALPARALFYIFIHLGGRTGFGQCPCNGLGWDFGFFLSS

SEQ ID NO: 47189 - protein, 170 aa, Homo sapiens
  Payload ID: 9556
  Gene Symbol: LDLR
  Gene Name: low density lipoprotein receptor
  ENSP ID: ENSP00000453696
  MOD_RES (1)..(1): Any amino acid
XNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLGQSILDRYHQRSHFQCQPPHRFRCQLVG

SEQ ID NO: 47190 - protein, 860 aa, Homo sapiens [sequence omitted]

SEQ ID NO: 47191 - protein, 308 aa, Homo sapiens
  Payload ID: 9557
  Gene Symbol: LDLRAP1
  Gene Name: low density lipoprotein receptor adaptor protein 1
  Uniprot ID: Q5SW96
  ENSP ID: ENSP00000363458
MDALKSAGRALIRSPSLAKQSWGGGGRHRKLPENWTDTRETLLEGMLFSLKYLGMTLVEQPKGEELSAAAIKRIVATAKASGKKLQKVTLKVSPRGIILTDNLTNQLIENVSIYRISYCTADKMHDKVFAYIAQSQHNQSLECHAFLCTKRKMAQAVTLTVAQAFKVAFEFWQVSKEEKEKRDKASQEGGDVLGARQDCTPSLKSLVATGNLLDLEETAKAPLSTVSANTTNMDEVPRPQALSGSSVVWELDDGLDEAFSRLAQSRTNPQVLDTGLTAQDMHYAQCLSPVDWDKPDSSGTEQDDLFSF

SEQ ID NO: 47192 - protein, 205 aa, Homo sapiens
  Payload ID: 9558
  Gene Symbol: LDLRAD1
  Gene Name: low density lipoprotein receptor class A domain containing 1
  Uniprot ID: Q5T700
  ENSP ID: ENSP00000360411
MNKVFPQGENGYTAAESKAHPGGEAGGGHLCCSRRGACLSASLLLLLATVAALIALVTILGLPSCTPGAQACITLTNRTGFLCHDQRSCIPASGVCDGVRTCTHGEDEDESLCRDVPQSLPHFLVAHCGDPASWIYSDQKCDGTNNCGDCSDELSPVTVCPPCGPGWWRCPSTFFKYCDCIPRHLCRDHVQHCSDWSDEYACPGP

SEQ ID NO: 47193 - protein, 116 aa, Homo sapiens
  Payload ID: 9558
  Gene Symbol: LDLRAD1
  Gene Name: low density lipoprotein receptor class A domain containing 1
  Uniprot ID: Q5T700
  ENSP ID: ENSP00000360413
MNKVFPQGENGYTAAESKAHPGGEGDVPQSLPHFLVAHCGDPASWIYSDQKCDGTNNCGDCSDELSPVTVCPPCGPGWWRCPSTFFKYCDCIPRHLCRDHVQHCSDWSDEYACPGP

SEQ ID NO: 47194 - protein, 166 aa, Homo sapiens
  Payload ID: 9558
  Gene Symbol: LDLRAD1
  Gene Name: low density lipoprotein receptor class A domain containing 1
  Uniprot ID: Q5T700
  ENSP ID: ENSP00000411017
MQGTRAELSAHSPSRAAGNRRHEQGLPPGAQACITLTNRTGFLCHDQRSCIPASGVCDGVRTCTHGEDEDESLCRDVPQSLPHFLVAHCGDPASWIYSDQKCDGTNNCGDCSDELSPVTVCPPCGPGWWRCPSTFFKYCDCIPRHLCRDHVQHCSDWSDEYACPGP

SEQ ID NO: 47195 - protein, 162 aa, Homo sapiens
  Payload ID: 9558
  Gene Symbol: LDLRAD1
  Gene Name: low density lipoprotein receptor class A domain containing 1
  Uniprot ID: Q5T700
  ENSP ID: ENSP00000445871
MNKVFPQGENGYTAAESKAHPGGEGAQACITLTNRTGFLCHDQRSCIPASGVCDGVRTCTHGEDEDESLCRDVPQSLPHFLVAHCGDPASWIYSDQKCDGTNNCGDCSDELSPVTVCPPCGPGWWRCPSTFFKYCDCIPRHLCRDHVQHCSDWSDEYACPGP

SEQ ID NO: 47196 - protein, 272 aa, Homo sapiens
  Payload ID: 9559
  Gene Symbol: LDLRAD2
  Gene Name: low density lipoprotein receptor class A domain containing 2
  Uniprot ID: Q5SZI1
  ENSP ID: ENSP00000340988
MEACCLLQLPQRLLLLGAAALTATALETADLAELCGQTWQGDGLLLRSHAASRRFYFVAPDTDCGLWVQAAAPGDRIRFQFRFFLVYSLTPAPPALNTSSPAPADPCAPGSYLQFYEGPPGAPRPLGSPLCGLNIPVPVASSGPFLGLRLVTRGRQPRVDFVGEVTSFRLGPCGAYFRCQNGRCIPSSLVCDPWGMDNCGDGSDQGSWSPADCRGPSPVPSQTGSTDAHTSRSLTPSPALGSAGSLWIAAERSSPAGRDPTRQDAALEGSTE

SEQ ID NO: 47197 - protein, 272 aa, Homo sapiens; identical to SEQ ID NO: 47196
  Payload ID: 9559
  Gene Symbol: LDLRAD2
  Gene Name: low density lipoprotein receptor class A domain containing 2
  Uniprot ID: Q5SZI1
  ENSP ID: ENSP00000444097

SEQ ID NO: 47198 - protein, 345 aa, Homo sapiens
  Payload ID: 9560
  Gene Symbol: LDLRAD3
  Gene Name: low density lipoprotein receptor class A domain containing 3
  Uniprot ID: Q86YD5
  ENSP ID: ENSP00000318607
MWLLGPLCLLLSSAAESQLLPGNNFTNECNIPGNFMCSNGRCIPGAWQCDGLPDCFDKSDEKECPKAKSKCGPTFFPCASGIHCIIGRFRCNGFEDCPDGSDEENCTANPLLCSTARYHCKNGLCIDKSFICDGQNNCQDNSDEESCESSQEPGSGQVFVTSENQLVYYPSITYAIIGSSVIFVLVVALLALVLHHQRKRNNLMTLPVHRLQHPVLLSRLVVLDHPHHCNVTYNVNNGIQYVASQAEQNASEVGSPPSYSEALLDQRPAWYDLPPPPYSSDTESLNQADLPPYRSRSGSANSASSQAASSLLSVEDTSHSPGQPGPQEGTAEPRDSEPSQGTEEV

SEQ ID NO: 47199 - protein, 296 aa, Homo sapiens
  Payload ID: 9560
  Gene Symbol: LDLRAD3
  Gene Name: low density lipoprotein receptor class A domain containing 3
  Uniprot ID: Q86YD5
  ENSP ID: ENSP00000433954
MWLLGPLCLLLSSAAAKAKSKCGPTFFPCASGIHCIIGRFRCNGFEDCPDGSDEENCTANPLLCSTARYHCKNGLCIDKSFICDGQNNCQDNSDEESCESSQEPGSGQVFVTSENQLVYYPSITYAIIGSSVIFVLVVALLALVLHHQRKRNNLMTLPVHRLQHPVLLSRLVVLDHPHHCNVTYNVNNGIQYVASQAEQNASEVGSPPSYSEALLDQRPAWYDLPPPPYSSDTESLNQADLPPYRSRSGSANSASSQAASSLLSVEDTSHSPGQPGPQEGTAEPRDSEPSQGTEEV

SEQ ID NO: 47200 - protein, 335 aa, Homo sapiens
  Payload ID: 9560
  Gene Symbol: LDLRAD3
  Gene Name: low density lipoprotein receptor class A domain containing 3
  ENSP ID: ENSP00000434313
MWLLGPLCLLLSSAAAKAKSKCGPTFFPCASGIHCIIGRFRCNGFEDCPDGSDEENCTANPLLCSTARYHCKNGLCIDKSFICDGQNNCQDNSDEESCESSQVSLLLPRLECSGTISAHCKLRLPGSRHSPASASRVAGTTEPGSGQVFVTSENQLVYYPSITYAIIGSSVIFVLVVALLALVLHHQRKRNNLMTLPVHRLQHPVLLSRLVVLDHPHHCNVTYNVNNGIQYVASQAEQNASEVGSPPSYSEALLDQRPAWYDLPPPPYSSDTESLNQADLPPYRSRSGSANSASSQAASSLLSVEDTSHSPGQPGPQEGTAEPRDSEPSQGTEEV

SEQ ID NO: 47201 - protein, 306 aa, Homo sapiens
  Payload ID: 9561
  Gene Symbol: LDLRAD4
  Gene Name: low density lipoprotein receptor class A domain containing 4
  Uniprot ID: O15165
  ENSP ID: ENSP00000352420
MPEAGFQATNAFTECKFTCTSGKCLYLGSLVCNQQNDCGDNSDEENCLLVTEHPPPGIFNSELEFAQIIIIVVVVTVMVVVIVCLLNHYKVSTRSFINRPNQSRRREDGLPQEGCLWPSDSAAPRLGASEIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 47202 - protein, 288 aa, Homo sapiens
  Payload ID: 9561
  Gene Symbol: LDLRAD4
  Gene Name: low density lipoprotein receptor class A domain containing 4
  Uniprot ID: O15165
  ENSP ID: ENSP00000382741
MPEAGFQATNAFTECKFTCTSGKCLYLGSLVCNQQNDCGDNSDEENCLLVTEHPPPGIFNSELEFAQIIIIVVVVTVMVVVIVCLLNHYKVSTRSFINRPNQSRRREDGLPQIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 47203 - protein, 69 aa, Homo sapiens
  Payload ID: 9561
  Gene Symbol: LDLRAD4
  Gene Name: low density lipoprotein receptor class A domain containing 4
  ENSP ID: ENSP00000465244
MPEAGFQATNAFTECKFTCTSGKCLYLGSLVCNQQNDCGDNSDEENCLLVTEHPPPGIFNSELEFAQII

SEQ ID NO: 47204 - protein, 43 aa, Homo sapiens
  Payload ID: 9561
  Gene Symbol: LDLRAD4
  Gene Name: low density lipoprotein receptor class A domain containing 4
  ENSP ID: ENSP00000465573
MPEAGFQATNAFTECKFTCTSGKCLYLGSLVCNQQNDCGDNSD

SEQ ID NO: 47205 - protein, 269 aa, Homo sapiens
  Payload ID: 9561
  Gene Symbol: LDLRAD4
  Gene Name: low density lipoprotein receptor class A domain containing 4
  Uniprot ID: O15165
  ENSP ID: ENSP00000466178
MSSDHLNNSTLKEAQFKDLFLKKAELEFAQIIIIVVVVTVMVVVIVCLLNHYKVSTRSFINRPNQSRRREDGLPQEGCLWPSDSAAPRLGASEIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 47206 - protein, 34 aa, Homo sapiens
  Payload ID: 9561
  Gene Symbol: LDLRAD4
  Gene Name: low density lipoprotein receptor class A domain containing 4
  ENSP ID: ENSP00000466490
MVVVIVCLLNHYKVSTRSFINRPNQSRRREDGLP

SEQ ID NO: 47207 - protein, 208 aa, Homo sapiens
  Payload ID: 9561
  Gene Symbol: LDLRAD4
  Gene Name: low density lipoprotein receptor class A domain containing 4
  Uniprot ID: O15165
  ENSP ID: ENSP00000466771
MRLDSHLECISSTQEGCLWPSDSAAPRLGASEIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 47208 - protein, 229 aa, Homo sapiens
  Payload ID: 9561
  Gene Symbol: LDLRAD4
  Gene Name: low density lipoprotein receptor class A domain containing 4
  Uniprot ID: O15165
  ENSP ID: ENSP00000466772
MVVVIVCLLNHYKVSTRSFINRPNQSRRREDGLPQEGCLWPSDSAAPRLGASEIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 47209 - protein, 251 aa, Homo sapiens
  Payload ID: 9561
  Gene Symbol: LDLRAD4
  Gene Name: low density lipoprotein receptor class A domain containing 4
  Uniprot ID: O15165
  ENSP ID: ENSP00000474783
MSSDHLNNSTLKEAQFKDLFLKKAELEFAQIIIIVVVVTVMVVVIVCLLNHYKVSTRSFINRPNQSRRREDGLPQIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 47210 - protein, 4544 aa, Homo sapiens
  Payload ID: 9562
  Gene Symbol: LRP1
  Gene Name: low density lipoprotein receptor-related protein 1
  Uniprot ID: Q07954
  ENSP ID: ENSP00000243077
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSQEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 47211 - protein, 292 aa, Homo sapiens
  Payload ID: 9562
  Gene Symbol: LRP1
  Gene Name: low density lipoprotein receptor-related protein 1
  Uniprot ID: Q07954
  ENSP ID: ENSP00000341264
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHLCVFSKSQQEMG

SEQ ID NO: 47212 - protein, 183 aa, Homo sapiens
  Payload ID: 9562
  Gene Symbol: LRP1
  Gene Name: low density lipoprotein receptor-related protein 1
  ENSP ID: ENSP00000451012
NGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECGEPRPHSRRKTVYLDERTCEPYQFRCKNNRCVPGRWQCDYDNDCGDNSDEESCTPRPCSESEFSCANGRCIAGRWKCDGDHDCAD

SEQ ID NO: 47213 - protein, 296 aa, Homo sapiens
  Payload ID: 9562
  Gene Symbol: LRP1
  Gene Name: low density lipoprotein receptor-related protein 1
  ENSP ID: ENSP00000451449
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHRRSRKRAQENEVTQHG

SEQ ID NO: 47214 - protein, 139 aa, Homo sapiens
  Payload ID: 9562
  Gene Symbol: LRP1
  Gene Name: low density lipoprotein receptor-related protein 1
  ENSP ID: ENSP00000451622
  MOD_RES (1)..(1): Any amino acid
XRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVNSLHAESTTVAARTCVCSLTRAMSTAHAEGAESSRMTSPA

SEQ ID NO: 47215 - protein, 439 aa, Homo sapiens
  Payload ID: 9562
  Gene Symbol: LRP1
  Gene Name: low density lipoprotein receptor-related protein 1
  ENSP ID: ENSP00000451737
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILVRELLSEVLWGNHDPGPSGEGGSLCRGTVL

SEQ ID NO: 47216 - protein, 713 aa, Homo sapiens
  Payload ID: 9563
  Gene Symbol: LRP10
  Gene Name: low density lipoprotein receptor-related protein 10
  Uniprot ID: Q7Z4F1
  ENSP ID: ENSP00000352601
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 47217 - protein, 556 aa, Homo sapiens
  Payload ID: 9563
  Gene Symbol: LRP10
  Gene Name: low density lipoprotein receptor-related protein 10
  Uniprot ID: Q7Z4F1
  ENSP ID: ENSP00000447559
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRL

SEQ ID NO: 47218 - protein, 458 aa, Homo sapiens
  Payload ID: 9563
  Gene Symbol: LRP10
  Gene Name: low density lipoprotein receptor-related protein 10
  ENSP ID: ENSP00000447977
  MOD_RES (1)..(1): Any amino acid
XAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRL

SEQ ID NO: 47219 - protein, 500 aa, Homo sapiens
  Payload ID: 9564
  Gene Symbol: LRP11
  Gene Name: low density lipoprotein receptor-related protein 11
  Uniprot ID: Q86VZ4
  ENSP ID: ENSP00000239367
MASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGGCLHTCSRYHFFCDDGCCIDITLACDGVQQCPDGSDEDFCQNLGLDRKMVTHTAASPALPRTTGPSEDAGGDSLVEKSQKATAPNKPPALSNTEKRNHSAFWGPESQIIPVMPDSSSSGKNRKEESYIFESKGDGGGGEHPAPETGAVLPLALGLAITALLLLMVACRLRLVKQKLKKARPITSEESDYLINGMYL

SEQ ID NO: 47220 - protein, 325 aa, Homo sapiens
  Payload ID: 9564
  Gene Symbol: LRP11
  Gene Name: low density lipoprotein receptor-related protein 11
  ENSP ID: ENSP00000356338
MASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGDGWSICCICSKREAKEFSETS

SEQ ID NO: 47221 - protein, 859 aa, Homo sapiens
  Payload ID: 9565
  Gene Symbol: LRP12
  Gene Name: low density lipoprotein receptor-related protein 12
  Uniprot ID: Q9Y561
  ENSP ID: ENSP00000276654
MACRWSTKESPRWRSALLLLFLAGVYGNGALAEHSENVHISGVSTACGETPEQIRAPSGIITSPGWPSEYPAKINCSWFIRANPGEIITISFQDFDIQGSRRCNLDWLTIETYKNIESYRACGSTIPPPYISSQDHIWIRFHSDDNISRKGFRLAYFSGKSEEPNCACDQFRCGNGKCIPEAWKCNNMDECGDSSDEEICAKEANPPTAAAFQPCAYNQFQCLSRFTKVYTCLPESLKCDGNIDCLDLGDEIDCDVPTCGQWLKYFYGTFNSPNYPDFYPPGSNCTWLIDTGDHRKVILRFTDFKLDGTGYGDYVKIYDGLEENPHKLLRVLTAFDSHAPLTVVSSSGQIRVHFCADKVNAARGFNATYQVDGFCLPWEIPCGGNWGCYTEQQRCDGYWHCPNGRDETNCTMCQKEEFPCSRNGVCYPRSDRCNYQNHCPNGSDEKNCFFCQPGNFHCKNNRCVFESWVCDSQDDCGDGSDEENCPVIVPTRVITAAVIGSLICGLLLVIALGCTCKLYSLRMFERRSFETQLSRVEAELLRREAPPSYGQLIAQGLIPPVEDFPVCSPNQASVLENLRLAVRSQLGFTSVRLPMAGRSSNIWNRIFNFARSRHSGSLALVSADGDEVVPSQSTSREPERNHTHRSLFSVESDDTDTENERRDMAGASGGVAAPLPQKVPPTTAVEATVGACASSSTQSTRGGHADNGRDVTSVEPPSVSPARHQLTSALSRMTQGLRWVRFTLGRSSSLSQNQSPLRQLDNGVSGREDDDDVEMLIPISDGSSDFDVNDCSRPLLDLASDQGQGLRQPYNATNPGVRPSNRDGPCERCGIVHTAQIPDTCLEVTLKNETSDDEALLLC

SEQ ID NO: 47222 - protein, 840 aa, Homo sapiens
  Payload ID: 9565
  Gene Symbol: LRP12
  Gene Name: low density lipoprotein receptor-related protein 12
  Uniprot ID: Q9Y561
  ENSP ID: ENSP00000399148
MACRWSTKESPRWRSALLLLFLAGVYACGETPEQIRAPSGIITSPGWPSEYPAKINCSWFIRANPGEIITISFQDFDIQGSRRCNLDWLTIETYKNIESYRACGSTIPPPYISSQDHIWIRFHSDDNISRKGFRLAYFSGKSEEPNCACDQFRCGNGKCIPEAWKCNNMDECGDSSDEEICAKEANPPTAAAFQPCAYNQFQCLSRFTKVYTCLPESLKCDGNIDCLDLGDEIDCDVPTCGQWLKYFYGTFNSPNYPDFYPPGSNCTWLIDTGDHRKVILRFTDFKLDGTGYGDYVKIYDGLEENPHKLLRVLTAFDSHAPLTVVSSSGQIRVHFCADKVNAARGFNATYQVDGFCLPWEIPCGGNWGCYTEQQRCDGYWHCPNGRDETNCTMCQKEEFPCSRNGVCYPRSDRCNYQNHCPNGSDEKNCFFCQPGNFHCKNNRCVFESWVCDSQDDCGDGSDEENCPVIVPTRVITAAVIGSLICGLLLVIALGCTCKLYSLRMFERRSFETQLSRVEAELLRREAPPSYGQLIAQGLIPPVEDFPVCSPNQASVLENLRLAVRSQLGFTSVRLPMAGRSSNIWNRIFNFARSRHSGSLALVSADGDEVVPSQSTSREPERNHTHRSLFSVESDDTDTENERRDMAGASGGVAAPLPQKVPPTTAVEATVGACASSSTQSTRGGHADNGRDVTSVEPPSVSPARHQLTSALSRMTQGLRWVRFTLGRSSSLSQNQSPLRQLDNGVSGREDDDDVEMLIPISDGSSDFDVNDCSRPLLDLASDQGQGLRQPYNATNPGVRPSNRDGPCERCGIVHTAQIPDTCLEVTLKNETSDDEALLLC

SEQ ID NO: 47223 - protein, 200 aa, Homo sapiens
  Payload ID: 9565
  Gene Symbol: LRP12
  Gene Name: low density lipoprotein receptor-related protein 12
  ENSP ID: ENSP00000429305
MCQKEEFPCSRNGVCYPRSDRCNYQNHCPNGSDEKNCFFCQPGNFHCKNNRCVFESWVCDSQDDCGDGSDEENCPVIVPTRVITAAVIGSLICGLLLVIALGCTCKLYSLRMFERRSFETQLSRVEAELLRREAPPSYGQLIAQGLIPPVEDFPVCSPNQASVLENLRLAVRSQLGFTSVRLPMAGRSSNIWNRIFNFAR

SEQ ID NO: 47224 - protein, 4599 aa, Homo sapiens
  Payload ID: 9566
  Gene Symbol: LRP1B
  Gene Name: low density lipoprotein receptor-related protein 1B
  Uniprot ID: Q9NZR2
  ENSP ID: ENSP00000374135
MSEFLLALLTLSGLLPIARVLTVGADRDQQLCDPGEFLCHDHVTCVSQSWLCDGDPDCPDDSDESLDTCPEEVEIKCPLNHIACLGTNKCVHLSQLCNGVLDCPDGYDEGVHCQELLSNCQQLNCQYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSIAIIVPLVLLVTLITTLVIGLVLCKRKRRTKTIRRQPIINGGINVEIGNPSYNMYEVDHDHNDGGLLDPGFMIDPTKARYIGGGPSAFKLPHTAPPIYLNSDLKGPLTAGPTNYSNPVYAKLYMDGQNCRNSLGSVDERKELLPKKIEIGIRETVA

SEQ ID NO: 47225 - protein, 280 aa, Homo sapiens
  Payload ID: 9566
  Gene Symbol: LRP1B
  Gene Name: low density lipoprotein receptor-related protein 1B
  ENSP ID: ENSP00000393859
  MOD_RES (1)..(1): Any amino acid
XRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSVGFKSQRCDQKENPCDHYCQNEGICTLTAFNEPRCKCSTNWSGTQCERPAPKSSKSDHISTRSIAIIVPLVLLVTLITTLVIGLVLCKRKRRTKTIRRQPIINGGINVEIGNPSYNMYEVDHDHNDGGLL

SEQ ID NO: 47226 - protein, 781 aa, Homo sapiens
  Payload ID: 9566
  Gene Symbol: LRP1B
  Gene Name: low density lipoprotein receptor-related protein 1B
  ENSP ID: ENSP00000413239
MSEFLLALLTLSGLLPIARVLTVGADRDQQLCDPGEFLCHDHVTCVSQSWLCDGDPDCPDDSDESLDTSRTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFIN

SEQ ID NO: 47227 - protein, 798 aa, Homo sapiens
  Payload ID: 9566
  Gene Symbol: LRP1B
  Gene Name: low density lipoprotein receptor-related protein 1B
  ENSP ID: ENSP00000415052
  MOD_RES (1)..(1): Any amino acid
XSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSIAIIVPLVLLVTLITTLVIGLVLCKRKRRTKTIRRQPIINGGINVEIGNPSYNMYEVDHDHNDGGLLDPGFMIDPTKPTNYSNPVYAKLYMDGQNCRNSLGSVDERKELLPKKIEIGIRETVA

SEQ ID NO: 47228 - protein, 4406 aa, Homo sapiens
  Payload ID: 9566
  Gene Symbol: LRP1B
  Gene Name: low density lipoprotein receptor-related protein 1B
  ENSP ID: ENSP00000478868
ELLSNCQQLNCQYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSIAIIVPLVLLVTLITTLVIGLVLCKRKRRTKTIRRQPIINGGINVEIGNPSYNMYEVDHDHNDGGLLDPGFMIDPTK

SEQ ID NO: 47229 - protein, 4655 aa, Homo sapiens
  Payload ID: 9567
  Gene Symbol: LRP2
  Gene Name: low density lipoprotein receptor-related protein 2
  Uniprot ID: P98164
  ENSP ID: ENSP00000263816
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTTAVAVLLTILLIVVIGALAIAGFFHYRRTGSLLPALPKLPSLSSLVKPSENGNGVTFRSGADLNMDIGVSGFGPETAIDRSMAMSEDFVMEMGKQPIIFENPMYSARDSAVKVVQPIQVTVSENVDNKNYGSPINPSEIVPETNPTSPAADGTQVTKWNLFKRKSKQTTNFENPIYAQMENEQKESVAATPPPSPSLPAKPKPPSRRDPTPTYSATEDTFKDTANLVKEDSEV

SEQ ID NO: 47230 - protein, 1225 aa, Homo sapiens
  Payload ID: 9567
  Gene Symbol: LRP2
  Gene Name: low density lipoprotein receptor-related protein 2
  ENSP ID: ENSP00000409813
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCSKFPDHSLLAINSF

SEQ ID NO: 47231 - protein, 770 aa, Homo sapiens
  Payload ID: 9568
  Gene Symbol: LRP3
  Gene Name: low density lipoprotein receptor-related protein 3
  Uniprot ID: O75074
  ENSP ID: ENSP00000253193
MEKRAAAGLEGAPGARAQLAVVCLVNIFLTGRLSSAVPALAACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRKVITAALIGSLVCGLLLVIALGCAFKLYSLRTQEYRAFETQMTRLEAEFVRREAPPSYGQLIAQGLIPPVEDFPVYSASQASVLQNLRTAMRRQMRRHASRRGPSRRRLGRLWNRLFHRPRAPRGQIPLLTAARPSQTVLGDGFLQPAPGAAPDPPAPLMDTGSTRAAGDRPPSAPGRAPEVGPSGPPLPSGLRDPECRPVDKDRKVCREPLVDGPAPADAPREPCSAQDPHPQVSTASSTLGPHSPEPLGVCRNPPPPCSPMLEASDDEALLVC

SEQ ID NO: 47232 - protein, 91 aa, Homo sapiens
  Payload ID: 9568
  Gene Symbol: LRP3
  Gene Name: low density lipoprotein receptor-related protein 3
  ENSP ID: ENSP00000476735
MITISFRNFDVEESHQCSLDWLLLGPAAPPRQEAFRLCGSAIPPAFISARDHVWIFFHSDASSSGQAQGFRLSYIRGKLGQASCQADEFRC

SEQ ID NO: 47233 - protein, 1905 aa, Homo sapiens
  Payload ID: 9569
  Gene Symbol: LRP4
  Gene Name: low density lipoprotein receptor-related protein 4
  Uniprot ID: O75096
  ENSP ID: ENSP00000367888
MRRQWGALLLGALLCAHGLASSPECACGRSHFTCAVSALGECTCIPAQWQCDGDNDCGDHSDEDGCILPTCSPLDFHCDNGKCIRRSWVCDGDNDCEDDSDEQDCPPRECEEDEFPCQNGYCIRSLWHCDGDNDCGDNSDEQCDMRKCSDKEFRCSDGSCIAEHWYCDGDTDCKDGSDEENCPSAVPAPPCNLEEFQCAYGRCILDIYHCDGDDDCGDWSDESDCSSHQPCRSGEFMCDSGLCINAGWRCDGDADCDDQSDERNCTTSMCTAEQFRCHSGRCVRLSWRCDGEDDCADNSDEENCENTGSPQCALDQFLCWNGRCIGQRKLCNGVNDCGDNSDESPQQNCRPRTGEENCNVNNGGCAQKCQMVRGAVQCTCHTGYRLTEDGHTCQDVNECAEEGYCSQGCTNSEGAFQCWCETGYELRPDRRSCKALGPEPVLLFANRIDIRQVLPHRSEYTLLLNNLENAIALDFHHRRELVFWSDVTLDRILRANLNGSNVEEVVSTGLESPGGLAVDWVHDKLYWTDSGTSRIEVANLDGAHRKVLLWQNLEKPRAIALHPMEGTIYWTDWGNTPRIEASSMDGSGRRIIADTHLFWPNGLTIDYAGRRMYWVDAKHHVIERANLDGSHRKAVISQGLPHPFAITVFEDSLYWTDWHTKSINSANKFTGKNQEIIRNKLHFPMDIHTLHPQRQPAGKNRCGDNNGGCTHLCLPSGQNYTCACPTGFRKISSHACAQSLDKFLLFARRMDIRRISFDTEDLSDDVIPLADVRSAVALDWDSRDDHVYWTDVSTDTISRAKWDGTGQEVVVDTSLESPAGLAIDWVTNKLYWTDAGTDRIEVANTDGSMRTVLIWENLDRPRDIVVEPMGGYMYWTDWGASPKIERAGMDASGRQVIISSNLTWPNGLAIDYGSQRLYWADAGMKTIEFAGLDGSKRKVLIGSQLPHPFGLTLYGERIYWTDWQTKSIQSADRLTGLDRETLQENLENLMDIHVFHRRRPPVSTPCAMENGGCSHLCLRSPNPSGFSCTCPTGINLLSDGKTCSPGMNSFLIFARRIDIRMVSLDIPYFADVVVPINITMKNTIAIGVDPQEGKVYWSDSTLHRISRANLDGSQHEDIITTGLQTTDGLAVDAIGRKVYWTDTGTNRIEVGNLDGSMRKVLVWQNLDSPRAIVLYHEMGFMYWTDWGENAKLERSGMDGSDRAVLINNNLGWPNGLTVDKASSQLLWADAHTERIEAADLNGANRHTLVSPVQHPYGLTLLDSYIYWTDWQTRSIHRADKGTGSNVILVRSNLPGLMDMQAVDRAQPLGFNKCGSRNGGCSHLCLPRPSGFSCACPTGIQLKGDGKTCDPSPETYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVSHVSHPFALTQQDRWIYWTDWQTKSIQRVDKYSGRNKETVLANVEGLMDIIVVSPQRQTGTNACGVNNGGCTHLCFARASDFVCACPDEPDSRPCSLVPGLVPPAPRATGMSEKSPVLPNTPPTTLYSSTTRTRTSLEEVEGRCSERDARLGLCARSNDAVPAAPGEGLHISYAIGGLLSILLILVVIAALMLYRHKKSKFTDPGMGNLTYSNPSYRTSTQEVKIEAIPKPAMYNQLCYKKEGGPDHNYTKEKIKIVEGICLLSGDDAEWDDLKQLRSSRGGLLRDHVCMKTDTVSIQASSGSLDDTETEQLLQEEQSECSSVHTAATPERRGSLPDTGWKHERKLSSESQV

SEQ ID NO: 47234 - protein, 133 aa, Homo sapiens
  Payload ID: 9569
  Gene Symbol: LRP4
  Gene Name: low density lipoprotein receptor-related protein 4
  ENSP ID: ENSP00000434763
MRRQWGALLLGALLCAHVLPTCSPLDFHCDNGKCIRRSWVCDGDNDCEDDSDEQDCPPRECEEDEFPCQNGYCIRSLWHCDGDNDCGDNSDEQCDMRKCSDKEFRCSDGSCIAEHWYCDGDTDCKDGSDEENC

SEQ ID NO: 47235 - protein, 1615 aa, Homo sapiens
  Payload ID: 9570
  Gene Symbol: LRP5
  Gene Name: low density lipoprotein receptor-related protein 5
  Uniprot ID: O75197
  ENSP ID: ENSP00000294304
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 47236 - protein, 172 aa, Homo sapiens
  Payload ID: 9570
  Gene Symbol: LRP5
  Gene Name: low density lipoprotein receptor-related protein 5
  ENSP ID: ENSP00000435315
  MOD_RES (1)..(1): Any amino acid
XSSSSSSTKATLYPPGLGSGCMLSRMALETHISPTPFGKLHVGLGCRQWHLWKILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 47237 - protein, 471 aa, Homo sapiens
  Payload ID: 9570
  Gene Symbol: LRP5
  Gene Name: low density lipoprotein receptor-related protein 5
  ENSP ID: ENSP00000436652
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMG

SEQ ID NO: 47238 - protein, 252 aa, Homo sapiens
  Payload ID: 9571
  Gene Symbol: LRP5L
  Gene Name: low density lipoprotein receptor-related protein 5-like
  Uniprot ID: A4QPB2
  ENSP ID: ENSP00000384291
MEGHVYWTDDEVWAIRRAYLDGSGAQTLINTKINDPDDIAVNWVARSLYWTHTGTEHIEVTCLNSTSHKILVSEDMDEPRAIALHPEMGLTYWIDWGENPEIKRANLDRQELRVLVNASLGWPNGLALDLQEGKLYWGDAKTDKIEAISVDETKRQTLLKDKLPHIFRFTLLGDFIYWTAWQHHSIKRVHKVKANRDVIIDQLPDLMGLKAVNVDKVVGTNPHADRNGGAATCASSRPTQPGLAAPSRAWNC

SEQ ID NO: 47239 - protein, 252 aa, Homo sapiens; identical to SEQ ID NO: 47238
  Payload ID: 9571
  Gene Symbol: LRP5L
  Gene Name: low density lipoprotein receptor-related protein 5-like
  Uniprot ID: A4QPB2
  ENSP ID: ENSP00000384562

SEQ ID NO: 47240 - protein, 224 aa, Homo sapiens
  Payload ID: 9571
  Gene Symbol: LRP5L
  Gene Name: low density lipoprotein receptor-related protein 5-like
  Uniprot ID: A4QPB2
  ENSP ID: ENSP00000407283
MEGHVYWTDDEVWAIRRAYLDGSGAQTLINTKINDPDDIAVNWVARSLYWTHTGTEHIEVTCLNSTSHKILVSEDMDEPRAIALHPEMGLTYWIDWGENPEIKRANLDRQELRVLVNASLGWPNGLALDLQEGKLYWGDAKTDKIEAISVDETKRQTLLKDKLPHIFRFTLLGDFIYWTAWQHHSIKRVHKVKANRDVIIDQLPDLMGLKAVNVDKVVGPGTAE

SEQ ID NO: 47241 - protein, 3 aa, Homo sapiens
  Payload ID: 9571
  Gene Symbol: LRP5L
  Gene Name: low density lipoprotein receptor-related protein 5-like
  ENSP ID: ENSP00000437736
MEG

SEQ ID NO: 47242 - protein, 70 aa, Homo sapiens
  Payload ID: 9571
  Gene Symbol: LRP5L
  Gene Name: low density lipoprotein receptor-related protein 5-like
  ENSP ID: ENSP00000438222
MEGHVYWTDDEVWAIRRAYLDGSGAQTLINTKINDPDDIAVNWVARSLYWTHTGTEHIEPHVLDRLGREP

SEQ ID NO: 47243 - protein, 252 aa, Homo sapiens; identical to SEQ ID NO: 47238
  Payload ID: 9571
  Gene Symbol: LRP5L
  Gene Name: low density lipoprotein receptor-related protein 5-like
  Uniprot ID: A4QPB2
  ENSP ID: ENSP00000482378

SEQ ID NO: 47244 - protein, 1613 aa, Homo sapiens
  Payload ID: 9572
  Gene Symbol: LRP6
  Gene Name: low density lipoprotein receptor-related protein 6
  Uniprot ID: O75581
  ENSP ID: ENSP00000261349
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAVVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDLNYDSEPVPPPPTPRSQYLSAEENYESCPPSPYTERSYSHHLYPPPPSPCTDSS

SEQ ID NO: 47245 - protein, 75 aa, Homo sapiens
  Payload ID: 9572
  Gene Symbol: LRP6
  Gene Name: low density lipoprotein receptor-related protein 6
  ENSP ID: ENSP00000439765
MYWTDWGEVPKIERAGMDGSSRFIIINSEIYWPNGLTLDYEEQKLYWADAKLNFIHKSNLDGTNRQAVVKGSLPH

SEQ ID NO: 47246 - protein, 1568 aa, Homo sapiens
  Payload ID: 9572
  Gene Symbol: LRP6
  Gene Name: low density lipoprotein receptor-related protein 6
  ENSP ID: ENSP00000442472
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAVVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDLNYDSEPVPPPPTPRSQYLSAEENYESCPPSPYTERSYSHHLYPPPPSPCTDSS

SEQ ID NO: 47247 - protein, 69 aa, Homo sapiens
  Payload ID: 9572
  Gene Symbol: LRP6
  Gene Name: low density lipoprotein receptor-related protein 6
  ENSP ID: ENSP00000443239
NCEVLCLIDQFRCANGQCIGKHKKCDHNVDCSDKSDELDCYFEPSTIPSHRAITLHYGIWIFFKQSFHS

SEQ ID NO: 47248 - protein, 1478 aa, Homo sapiens
  Payload ID: 9572
  Gene Symbol: LRP6
  Gene Name: low density lipoprotein receptor-related protein 6
  ENSP ID: ENSP00000445083
  MOD_RES (1)..(1): Any amino acid
XLDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAVVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDLNYDSEPVPPPPTPRSQYLSAEENYESCPPSPYTERSYSHHLYPPPPSPCTDSS

SEQ ID NO: 47249 - protein, 1613 aa, Homo sapiens; identical to SEQ ID NO: 47244
  Payload ID: 9572
  Gene Symbol: LRP6
  Gene Name: low density lipoprotein receptor-related protein 6
  Uniprot ID: O75581
  ENSP ID: ENSP00000486315

SEQ ID NO: 47250 - protein, 75 aa, Homo sapiens; identical to SEQ ID NO: 47245
  Payload ID: 9572
  Gene Symbol: LRP6
  Gene Name: low density lipoprotein receptor-related protein 6
  ENSP ID: ENSP00000486383

SEQ ID NO: 47251 - protein, 1568 aa, Homo sapiens; identical to SEQ ID NO: 47246
  Payload ID: 9572
  Gene Symbol: LRP6
  Gene Name: low density lipoprotein receptor-related protein 6
  ENSP ID: ENSP00000486524

SEQ ID NO: 47252 - protein, 69 aa, Homo sapiens; identical to SEQ ID NO: 47247
  Payload ID: 9572
  Gene Symbol: LRP6
  Gene Name: low density lipoprotein receptor-related protein 6
  ENSP ID: ENSP00000486758

SEQ ID NO: 47253 - protein, 1478 aa, Homo sapiens; identical to SEQ ID NO: 47248
  Payload ID: 9572
  Gene Symbol: LRP6
  Gene Name: low density lipoprotein receptor-related protein 6
  ENSP ID: ENSP00000487008
  MOD_RES (1)..(1): Any amino acid

SEQ ID NO: 47254 - protein, 963 aa, Homo sapiens
  Payload ID: 9573
  Gene Symbol: LRP8
  Gene Name: low density lipoprotein receptor-related protein 8, apolipoprotein e receptor
  Uniprot ID: Q14114
  ENSP ID: ENSP00000303634
MGLPEPGPLRLLALLLLLLLLLLLQLQHLAAAAADPLLGGQGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATASQFACRSGECVHLGWRCDGDRDCKDKSDEADCPLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPAAISSFDRPLWAEPCLGETREPEDPAPALKELFVLPGEPRSQLHQLPKNPLSELPVVKSKRVALSLEDDGLP

SEQ ID NO: 47255 - protein, 793 aa, Homo sapiens
  Payload ID: 9573
  Gene Symbol: LRP8
  Gene Name: low density lipoprotein receptor-related protein 8, apolipoprotein e receptor
  Uniprot ID: Q14114
  ENSP ID: ENSP00000334522
MGLPEPGPLRLLALLLLLLLLLLLQLQHLAAAAADPLLGGQGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATWLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPAAISSFDRPLWAEPCLGETREPEDPAPALKELFVLPGEPRSQLHQLPKNPLSELPVVKSKRVALSLEDDGLP

SEQ ID NO: 47256 - protein, 700 aa, Homo sapiens
  Payload ID: 9573
  Gene Symbol: LRP8
  Gene Name: low density lipoprotein receptor-related protein 8, apolipoprotein e receptor
  Uniprot ID: Q14114
  ENSP ID: ENSP00000346391
MGLPEPGPLRLLALLLLLLLLLLLQLQHLAAAAADPLLGGQGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATSLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRDANEDSKMGSTVTAAVIGIIVPIVVIALLCMSGYLIWRNWKRKNTKSMNFDNPVYRKTTEEEDEDELHIGRTAQIGHVYPARVALSLEDDGLP

SEQ ID NO: 47257 - protein, 904 aa, Homo sapiens
  Payload ID: 9573
  Gene Symbol: LRP8
  Gene Name: low density lipoprotein receptor-related protein 8, apolipoprotein e receptor
  Uniprot ID: Q14114
  ENSP ID: ENSP00000360509
MGLPEPGPLRLLALLLLLLLLLLLQLQHLAAAAADPLLGGQGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATASQFACRSGECVHLGWRCDGDRDCKDKSDEADCPLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPARVALSLEDDGLP

SEQ ID NO: 47258 - protein, 121 aa, Homo sapiens
  Payload ID: 9573
  Gene Symbol: LRP8
  Gene Name: low density lipoprotein receptor-related protein 8, apolipoprotein e receptor
  ENSP ID: ENSP00000431241
  MOD_RES (1)..(1): Any amino acid
XPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPARVALSLEDDGLP

SEQ ID NO: 47259 - protein, 392 aa, Homo sapiens
  Payload ID: 9573
  Gene Symbol: LRP8
  Gene Name: low density lipoprotein receptor-related protein 8, apolipoprotein e receptor
  ENSP ID: ENSP00000433554
MGLPEPGPLRLLALLLLLLLLLLLQLQHLAAAAADPLLGGQGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATASQFACRSGECVHLGWRCDGDRDCKDKSDEADCPLGTCRGDEFQCGDGTCVLAIKHCNQEQDCPDGSDEAGCLQESPCEGPRRFQCKSGKRVDGGKVCDVQRDCRDWSDELLKVWAERVSAQQWRLLTHLH

SEQ ID NO: 47260 - protein, 135 aa, Homo sapiens
  Payload ID: 9573
  Gene Symbol: LRP8
  Gene Name: low density lipoprotein receptor-related protein 8, apolipoprotein e receptor
  ENSP ID: ENSP00000435346
  MOD_RES (1)..(1): Any amino acid
XVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGSAEPALVLGRLQATPTVQH

SEQ ID NO: 47261 - protein, 240 aa, Homo sapiens
  Payload ID: 9573
  Gene Symbol: LRP8
  Gene Name: low density lipoprotein receptor-related protein 8, apolipoprotein e receptor
  ENSP ID: ENSP00000436651
  MOD_RES (1)..(1): Any amino acid
XDGSDEAGCLQVPPTFLGNRRRPRGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLR

SEQ ID NO: 47262 - protein, 457 aa, Homo sapiens
  Payload ID: 9573
  Gene Symbol: LRP8
  Gene Name: low density lipoprotein receptor-related protein 8, apolipoprotein e receptor
  ENSP ID: ENSP00000437009
MLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPARVALSLEDDGLP

SEQ ID NO: 47263 - protein, 699 aa, Homo sapiens
  Payload ID: 9573
  Gene Symbol: LRP8
  Gene Name: low density lipoprotein receptor-related protein 8, apolipoprotein e receptor
  ENSP ID: ENSP00000480025
MGLPEPGPLRLLALLLLLLLLLLLQLQHLAAAAADPLLGGQGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATSLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRTGAEDRPVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRDANEDSKMGSTVTAAVIGIIVPIVVIALLCMSGYLIWRNWKRKNTKSMNFDNPVYRKTTEEEDEDELHIGRTAQIGHVYPARVALSLEDDGLP

SEQ ID NO: 47264 - protein, 105 aa, Homo sapiens
  Payload ID: 9574
  Gene Symbol: LRPAP1
  Gene Name: low density lipoprotein receptor-related protein associated protein 1
  ENSP ID: ENSP00000421648
MAPRRVRSFLRGLPALLLLLLFLGPWPAASHGGKYSREKNQPKPSPKRESGEEFRMEKLNQLWEKAQRNLPVASLLRGQFLAVSWSVLLVAHRLLPFVRSCIFLP

SEQ ID NO: 47265 - protein, 357 aa, Homo sapiens
  Payload ID: 9574
  Gene Symbol: LRPAP1
  Gene Name: low density lipoprotein receptor-related protein associated protein 1
  Uniprot ID: P30533
  ENSP ID: ENSP00000421922
MAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 47266 - protein, 2863 aa, Homo sapiens
  Payload ID: 9575
  Gene Symbol: LRBA
  Gene Name: LPS-responsive vesicle trafficking, beach and anchor containing
  Uniprot ID: P50851
  ENSP ID: ENSP00000349629
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCGQMTAVYLFSEALNAAQIFAIYQLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMELLKNSIAMQEQMLACKGFLVIGYSLEKSSKSHVSRAVLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHLAPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDASEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRSHSTKTVMDFVNSSDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHVCIFKLRENSKATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGTHYSTASFVLAWLLRIEPFTTYFLNLQGGKFDHADRTFSSISRAWRNSQRDTSDIKELIPEFYYLPEMFVNFNNYNLGVMDDGTVVSDVELPPWAKTSEEFVHINRLALESEFVSCQLHQWIDLIFGYKQQGPEAVRALNVFYYLTYEGAVNLNSITDPVLREAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 47267 - protein, 2851 aa, Homo sapiens
  Payload ID: 9575
  Gene Symbol: LRBA
  Gene Name: LPS-responsive vesicle trafficking, beach and anchor containing
  Uniprot ID: P50851
  ENSP ID: ENSP00000421552
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCGQMTAVYLFSEALNAAQIFAIYQLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMELLKNSIAMQEQMLACKGFLVIGYSLEKSSKSHVSRAVLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHLAPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDASEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRSHSTKTVMDFVNSSDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGTHYSTASFVLAWLLRIEPFTTYFLNLQGGKFDHADRTFSSISRAWRNSQRDTSDIKELIPEFYYLPEMFVNFNNYNLGVMDDGTVVSDVELPPWAKTSEEFVHINRLALESEFVSCQLHQWIDLIFGYKQQGPEAVRALNVFYYLTYEGAVNLNSITDPVLREAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 47268 - protein, 2575 aa, Homo sapiens
  Payload ID: 9575
  Gene Symbol: LRBA
  Gene Name: LPS-responsive vesicle trafficking, beach and anchor containing
  ENSP ID: ENSP00000422180
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCGQMTAVYLFSEALNAAQIFAIYQLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMELLKNSIAMQEQMLACKGFLVIGYSLEKSSKSHVSRAVLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHLAPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDASEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRSHSTKTVMDFVNSSDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGTHYSTASFVLAWLLRIEPFTTYFLNLQGGKFDHADRTFSSISRAWRNSQRDTSDIKELIPEFYYLPEMFVNFNNYNLGVMDDGTVVSDVELPPWAKTSEEFVHINRLALESEFVSCQLHQWIDLIFGYKQQGPEAVRALNVFYYLTYEGAVNLNSITDPVLREAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIGLSLPSLFAIH

SEQ ID NO: 47269 - protein, 134 aa, Homo sapiens
  Payload ID: 9575
  Gene Symbol: LRBA
  Gene Name: LPS-responsive vesicle trafficking, beach and anchor containing
  ENSP ID: ENSP00000424640
GFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDITKKSLHMNLQNIIDFVRSRITNMSKNCIKWICSN

SEQ ID NO: 47270 - protein, 147 aa, Homo sapiens
  Payload ID: 9575
  Gene Symbol: LRBA
  Gene Name: LPS-responsive vesicle trafficking, beach and anchor containing
  ENSP ID: ENSP00000425852
  MOD_RES (1)..(1): Any amino acid
XYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRVHHFWHGFRKHCAILQRL

SEQ ID NO: 47271 - protein, 1505 aa, Homo sapiens
  Payload ID: 9575
  Gene Symbol: LRBA
  Gene Name: LPS-responsive vesicle trafficking, beach and anchor containing
  ENSP ID: ENSP00000426669
  MOD_RES (1)..(1): Any amino acid
XDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGTHYSTASFVLAWLLRIEPFTTYFLNLQGGKFDHADRTFSSISRAWRNSQRDTSDIKELIPEFYYLPEMFVNFNNYNLGVMDDGTVVSDVELPPWAKTSEEFVHINRLALESEFVSCQLHQWIDLIFGYKQQGPEAVRALNVFYYLTYEGAVNLNSITDPVLREAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 47272 - protein, 1070 aa, Homo sapiens; identical to SEQ ID NO: 45954
  Payload ID: 9576
  Gene Symbol:
  Gene Name: LRIG1
  ENSP ID: ENSP00000488182

SEQ ID NO: 47273 - protein, 1093 aa, Homo sapiens; identical to SEQ ID NO: 45953
  Payload ID: 9576
  Gene Symbol:
  Gene Name: LRIG1
  ENSP ID: ENSP00000488729

SEQ ID NO: 47274 - protein, 347 aa, Homo sapiens
  Payload ID: 9577
  Gene Symbol: LRP2BP
  Gene Name: LRP2 binding protein
  Uniprot ID: Q9P2M1
  ENSP ID: ENSP00000332681
MKLTSEKLPKNPFYASVSQYAAKNQKFFQWKKEKTDYTHANLVDKALQLLKERILKGDTLAYFLRGQLYFEEGWYEEALEQFEEIKEKDHQATYQLGVMYYDGLGTTLDAEKGVDYMKKILDSPCPKARHLKFAAAYNLGRAYYEGKGVKRSNEEAERLWLIAADNGNPKASVKAQSMLGLYYSTKEPKELEKAFYWHSEACGNGNLESQGALGLMYLYGQGIRQDTEAALQCLREAAERGNVYAQGNLVEYYYKMKFFTKCVAFSKRIADYDEVHDIPMIAQVTDCLPEFIGRGMAMASFYHARCLQLGLGITRDETTAKHYYSKACRLNPALADELHSLLIRQRI

SEQ ID NO: 47275 - protein, 153 aa, Homo sapiens
  Payload ID: 9577
  Gene Symbol: LRP2BP
  Gene Name: LRP2 binding protein
  ENSP ID: ENSP00000421244
MKLTSEKLPKNPFYASVSQYAAKNQKFFQWKKEKTDYTHANLVDKALQLLKERILKGDTLAYFLRGQLYFEEGWYEEALEQFEEIKEKDHQATYQLGVMYYDGLGTTLDAEKGVDYMKKILDSPCPKARHLKFAAAYNLGRAYYEGKGVKRSN

SEQ ID NO: 47276 - protein, 321 aa, Homo sapiens
  Payload ID: 9577
  Gene Symbol: LRP2BP
  Gene Name: LRP2 binding protein
  ENSP ID: ENSP00000424610
MEFLTFLKSDYTHANLVDKALQLLKERILKGDTLAYFLRGQLYFEEGWYEEALEQFEEIKEKDHQATYQLGVMYYDGLGTTLDAEKGVDYMKKILDSPCPKARHLKFAAAYNLGRAYYEGKGVKRSNEEAERLWLIAADNGNPKASVKAQSMLGLYYSTKEPKELEKAFYWHSEACGNGNLESQGALGLMYLYGQGIRQDTEAALQCLREAAERGNVYAQGNLVEYYYKMKFFTKCVAFSKRIADYDEVHDIPMIAQVTDCLPEFIGRGMAMASFYHARCLQLGLGITRDETTAKHYYSKACRLNPALADELHSLLIRQRI

SEQ ID NO: 47277 - protein, 347 aa, Homo sapiens; identical to SEQ ID NO: 47274
  Payload ID: 9577
  Gene Symbol: LRP2BP
  Gene Name: LRP2 binding protein
  Uniprot ID: Q9P2M1
  ENSP ID: ENSP00000426203

SEQ ID NO: 47278 - protein, 238 aa, Homo sapiens
  Payload ID: 9578
  Gene Symbol: LRRN4CL
  Gene Name: LRRN4 C-terminal like
  Uniprot ID: Q8ND94
  ENSP ID: ENSP00000325808
MLGSPCLLWLLAVTFLVPRAQPLAPQDFEEEEADETETAWPPLPAVPCDYDHCRHLQVPCKELQRVGPAACLCPGLSSPAQPPDPPRMGEVRIAAEEGRAVVHWCAPFSPVLHYWLLLWDGSEAAQKGPPLNATVRRAELKGLKPGGIYVVCVVAANEAGASRVPQAGGEGLEGADIPAFGPCSRLAVPPNPRTLVHAAVGVGTALALLSCAALVWHFCLRDRWGCPRRAAARAAGAL

SEQ ID NO: 47279 - protein, 385 aa, Homo sapiens
  Payload ID: 9579
  Gene Symbol: LSM14B
  Gene Name: LSM family member 14B
  Uniprot ID: Q9BX40
  ENSP ID: ENSP00000279068
MSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKTSSRRTTWAEERKLNTETFGVSGRFLRGRSSRGGFRGGRGNGTTRRNPTSHRAGTGRV

SEQ ID NO: 47280 - protein, 223 aa, Homo sapiens
  Payload ID: 9579
  Gene Symbol: LSM14B
  Gene Name: LSM family member 14B
  ENSP ID: ENSP00000279069
MSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLGAGFPSIPVGKSPMVEQAVQTGSADNLNAKKLLPGKGTTGTQLNGRQAQPSSKTASGNRRTRNRSRGQNRPTNVKENTIKF

SEQ ID NO: 47281 - protein, 248 aa, Homo sapiens
  Payload ID: 9579
  Gene Symbol: LSM14B
  Gene Name: LSM family member 14B
  ENSP ID: ENSP00000355209
MAPYGPLAASSLLSQQYAASLGLEKLVSPPASAAASSPSSSPSPQPVSELDLSSEPQQLTAKGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKT

SEQ ID NO: 47282 - protein, 221 aa, Homo sapiens
  Payload ID: 9579
  Gene Symbol: LSM14B
  Gene Name: LSM family member 14B
  ENSP ID: ENSP00000359953
MSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLEKLVSPPASAAASSPSSSPSPQPVSELDLSSEPQQLTAKGNSSLGELHAVLQTILRARGKAADRMTVAVADHLPSPCSR

SEQ ID NO: 47283 - protein, 296 aa, Homo sapiens
  Payload ID: 9579
  Gene Symbol: LSM14B
  Gene Name: LSM family member 14B
  ENSP ID: ENSP00000383172
MSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQLNKRPDEGVRGDGMAFAVLTRCLVVQSSLGSASASPFQPHVPYSPFRGMAPYGPLAASSLLSQQYAASLGLGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKE

SEQ ID NO: 47284 - protein, 133 aa, Homo sapiens
  Payload ID: 9580
  Gene Symbol: LSM1
  Gene Name: LSM1 homolog, mRNA degradation associated
  Uniprot ID: O15116
  ENSP ID: ENSP00000310596
MNYMPGTASLIEDIDKKHLVLLRDGRTLIGFLRSIDQFANLVLHQTVERIHVGKKYGDIPRGIFVVRGENVVLLGEIDLEKESDTPLQQVSIEEILEEQRVEQQTKLEAEKLKVQALKDRGLSIPRADTLDEY

SEQ ID NO: 47285 - protein, 44 aa, Homo sapiens
  Payload ID: 9580
  Gene Symbol: LSM1
  Gene Name: LSM1 homolog, mRNA degradation associated
  ENSP ID: ENSP00000428307
MNYMPGTASLIEDIDKKHLVLLRDGRTLIGFLRSIDQFGTSCSC

SEQ ID NO: 47286 - protein, 44 aa, Homo sapiens
  Payload ID: 9580
  Gene Symbol: LSM1
  Gene Name: LSM1 homolog, mRNA degradation associated
  ENSP ID: ENSP00000430021
MNYMPGTASLIEDIDKKHLVLLRDGRTLIGFLRSIDQFGLGKGE

SEQ ID NO: 47287 - protein, 123 aa, Homo sapiens
  Payload ID: 9581
  Gene Symbol: LSM10
  Gene Name: LSM10, U7 small nuclear RNA associated
  Uniprot ID: Q969L4
  ENSP ID: ENSP00000319341
MAVSHSVKERTISENSLIILLQGLQGRVTTVDLRDESVAHGRIDNVDAFMNIRLAKVTYTDRWGHQVKLDDLFVTGRNVRYVHIPDDVNITSTIEQQLQIIHRVRNFGGKGQGRWEFPPKNCK

SEQ ID NO: 47288 - protein, 360 aa, Homo sapiens
  Payload ID: 9582
  Gene Symbol: LSM11
  Gene Name: LSM11, U7 small nuclear RNA associated
  Uniprot ID: P83369
  ENSP ID: ENSP00000286307
MEERERGARSAGAGSPARPPSPRLDVSSDSFDPLLALYAPRLPPIPYPNAPCFNNVAEYESFLRTGVRGGGRGRGRARGAAAGSGVPAAPGPSGRTRRRPDAPAPDPERIQRLRRLMVAKEEGDGAAGAGRRGPGRSRKAPRNVLTRMPLHEGSPLGELHRCIREGVKVNVHIRTFKGLRGVCTGFLVAFDKFWNMALTDVDETYRKPVLGKAYERDSSLTLTRLFDRLKLQDSSKKEADSKSAVEDSTLSRYSQTSTWKLASVWGRADTGRGSHKRSRSVPSSLQASAREESRSELSGRTTRTDGSSVGGTFSRATTLSRGQSRKKKRKPKVDYQQVFTRHINQIFIRGENVLLVHLAQ

SEQ ID NO: 47289 - protein, 195 aa, Homo sapiens
  Payload ID: 9583
  Gene Symbol: LSM12
  Gene Name: LSM12 homolog
  Uniprot ID: Q3MHD2
  ENSP ID: ENSP00000293406
MAAPPGEYFSVGSQVSCRTCQEQRLQGEVVAFDYQSKMLALKCPSSSGKPNHADILLINLQYVSEVEIINDRTETPPPLASLNVSKLASKARTEKEEKLSQAYAISAGVSLEGQQLFQTIHKTIKDCKWQEKNIVVMEEVVITPPYQVENCKGKEGSALSHVRKIVEKHFRDVESQKILQRSQAQQPQKEAALSS

SEQ ID NO: 47290 - protein, 230 aa, Homo sapiens
  Payload ID: 9583
  Gene Symbol: LSM12
  Gene Name: LSM12 homolog
  ENSP ID: ENSP00000466074
MAAPPGEYFSVGSQVSCRTCQEQRLQGEVVAFDYQSKMLALKCPSSSGKPNHADILLINLQYVSEVEIINDRTETPPPLASLNVSKLASKARTEKEEKLSQAYAISAGVSLEGQQLFQTIHKTIKDCKWQEKNIVVMEEVVITPPYQVENCKGKEGSALSHVRKIRQSLALSPTLECSGAISAHCNLRLPGSSDSPASASRVPGTTGVCHHTRLEMGFHHVGQAGLELLT

SEQ ID NO: 47291 - protein, 195 aa, Homo sapiens; identical to SEQ ID NO: 47289
  Payload ID: 9583
  Gene Symbol: LSM12
  Gene Name: LSM12 homolog
  Uniprot ID: Q3MHD2
  ENSP ID: ENSP00000466718

SEQ ID NO: 47292 - protein, 463 aa, Homo sapiens
  Payload ID: 9584
  Gene Symbol: LSM14A
  Gene Name: LSM14A mRNA processing body assembly factor
  Uniprot ID: Q8ND56
  ENSP ID: ENSP00000413964
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKTTAFGP

SEQ ID NO: 47293 - protein, 463 aa, Homo sapiens
  Payload ID: 9584
  Gene Symbol: LSM14A
  Gene Name: LSM14A mRNA processing body assembly factor
  Uniprot ID: Q8ND56
  ENSP ID: ENSP00000446271
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKDNKVAA

SEQ ID NO: 47294 - protein, 422 aa, Homo sapiens
  Payload ID: 9584
  Gene Symbol: LSM14A
  Gene Name: LSM14A mRNA processing body assembly factor
  Uniprot ID: Q8ND56
  ENSP ID: ENSP00000446451
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKTTAFGP

SEQ ID NO: 47295 - protein, 463 aa, Homo sapiens; identical to SEQ ID NO: 47292
  Payload ID: 9584
  Gene Symbol: LSM14A
  Gene Name: LSM14A mRNA processing body assembly factor
  Uniprot ID: Q8ND56
  ENSP ID: ENSP00000459843

SEQ ID NO: 47296 - protein, 80 aa, Homo sapiens
  Payload ID: 9584
  Gene Symbol: LSM14A
  Gene Name: LSM14A mRNA processing body assembly factor
  ENSP ID: ENSP00000460420
TWAEERRLNAETFGIPLRPNRGRGGYRGRGGLGFRGGRGRGGGRGGTFTAPRGFRGGFRGGRGGREFADFEYRKDNKVAA

SEQ ID NO: 47297 - protein, 344 aa, Homo sapiens
  Payload ID: 9584
  Gene Symbol: LSM14A
  Gene Name: LSM14A mRNA processing body assembly factor
  ENSP ID: ENSP00000460896
PYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGG

SEQ ID NO: 47298 - protein, 463 aa, Homo sapiens; identical to SEQ ID NO: 47293
  Payload ID: 9584
  Gene Symbol: LSM14A
  Gene Name: LSM14A mRNA processing body assembly factor
  Uniprot ID: Q8ND56
  ENSP ID: ENSP00000461225

SEQ ID NO: 47299 - protein, 102 aa, Homo sapiens
  Payload ID: 9584
  Gene Symbol: LSM14A
  Gene Name: LSM14A mRNA processing body assembly factor
  ENSP ID: ENSP00000461436
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSRWSTVA

SEQ ID NO: 47300 - protein, 314 aa, Homo sapiens
  Payload ID: 9584
  Gene Symbol: LSM14A
  Gene Name: LSM14A mRNA processing body assembly factor
  ENSP ID: ENSP00000466725
PYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDN

SEQ ID NO: 47301 - protein, 102 aa, Homo sapiens; identical to SEQ ID NO: 47299
  Payload ID: 9584
  Gene Symbol: LSM14A
  Gene Name: LSM14A mRNA processing body assembly factor
  ENSP ID: ENSP00000468130

SEQ ID NO: 47302 - protein, 148 aa, Homo sapiens
  Payload ID: 9584
  Gene Symbol: LSM14A
  Gene Name: LSM14A mRNA processing body assembly factor
  ENSP ID: ENSP00000485334
  MOD_RES (1)..(1): Any amino acid
XDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRVSVTVNKFFGVDM

SEQ ID NO: 47303 - protein, 144 aa, Homo sapiens
  Payload ID: 9584
  Gene Symbol: LSM14A
  Gene Name: LSM14A mRNA processing body assembly factor
  ENSP ID: ENSP00000485590
EKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRVSVTVNKFFGVDM

SEQ ID NO: 47304 - protein, 95 aa, Homo sapiens
  Payload ID: 9585
  Gene Symbol: LSM2
  Gene Name: LSM2 homolog, U6 small nuclear RNA and mRNA degradation associated
  Uniprot ID: Q9Y333
  ENSP ID: ENSP00000364813
MLFYSFFKSLVGKDVVVELKNDLSICGTLHSVDQYLNIKLTDISVTDPEKYPHMLSVKNCFIRGSVVRYVQLPADEVDTQLLQDAARKEALQQKQ

SEQ ID NO: 47305 - protein, 95 aa, Homo sapiens; identical to SEQ ID NO: 47304
  Payload ID: 9585
  Gene Symbol: LSM2
  Gene Name: LSM2 homolog, U6 small nuclear RNA and mRNA degradation associated
  Uniprot ID: Q9Y333
  ENSP ID: ENSP00000372883

SEQ ID NO: 47306 - protein, 95 aa, Homo sapiens; identical to SEQ ID NO: 47304
  Payload ID: 9585
  Gene Symbol: LSM2
  Gene Name: LSM2 homolog, U6 small nuclear RNA and mRNA degradation associated
  Uniprot ID: Q9Y333
  ENSP ID: ENSP00000403345

SEQ ID NO: 47307 - protein, 95 aa, Homo sapiens; identical to SEQ ID NO: 47304
  Payload ID: 9585
  Gene Symbol: LSM2
  Gene Name: LSM2 homolog, U6 small nuclear RNA and mRNA degradation associated
  Uniprot ID: Q9Y333
  ENSP ID: ENSP00000406280

SEQ ID NO: 47308 - protein, 95 aa, Homo sapiens; identical to SEQ ID NO: 47304
  Payload ID: 9585
  Gene Symbol: LSM2
  Gene Name: LSM2 homolog, U6 small nuclear RNA and mRNA degradation associated
  Uniprot ID: Q9Y333
  ENSP ID: ENSP00000414006

SEQ ID NO: 47309 - protein, 95 aa, Homo sapiens; identical to SEQ ID NO: 47304
  Payload ID: 9585
  Gene Symbol: LSM2
  Gene Name: LSM2 homolog, U6 small nuclear RNA and mRNA degradation associated
  Uniprot ID: Q9Y333
  ENSP ID: ENSP00000414634

SEQ ID NO: 47310 - protein, 102 aa, Homo sapiens
  Payload ID: 9586
  Gene Symbol: LSM3
  Gene Name: LSM3 homolog, U6 small nuclear RNA and mRNA degradation associated
  Uniprot ID: P62310
  ENSP ID: ENSP00000302160
MADDVDQQQTTNTVEEPLDLIRLSLDERIYVKMRNDRELRGRLHAYDQHLNMILGDVEETVTTIEIDEETYEEIYKSTKRNIPMLFVRGDGVVLVAPPLRVG

SEQ ID NO: 47311 - protein, 69 aa, Homo sapiens
  Payload ID: 9587
  Gene Symbol: LSM4
  Gene Name: LSM4 homolog, U6 small nuclear RNA and mRNA degradation associated
  ENSP ID: ENSP00000469028
MLPLSLLKTAQNHPMLVELKNGETYNGHLVSCDNWMNINLREVICTSRVKNPNQREPHPRLEGAPVSHS

SEQ ID NO: 47312 - protein, 139 aa, Homo sapiens
  Payload ID: 9587
  Gene Symbol: LSM4
  Gene Name: LSM4 homolog, U6 small nuclear RNA and mRNA degradation associated
  Uniprot ID: Q9Y4Z0
  ENSP ID: ENSP00000469468
MLPLSLLKTAQNHPMLVELKNGETYNGHLVSCDNWMNINLREVICTSRDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 47313 - protein, 125 aa, Homo sapiens
  Payload ID: 9587
  Gene Symbol: LSM4
  Gene Name: LSM4 homolog, U6 small nuclear RNA and mRNA degradation associated
  ENSP ID: ENSP00000475950
MLVELKNGETYNGHLVSCDNWMNINLREVICTSRDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 47314 - protein, 109 aa, Homo sapiens
  Payload ID: 9587
  Gene Symbol: LSM4
  Gene Name: LSM4 homolog, U6 small nuclear RNA and mRNA degradation associated
  ENSP ID: ENSP00000476184
MGGTQDQSSQALVKQTNHVALFAFQLPLSLLKTAQNHPMLVELKNGETYNGHLVSCDNWMNINLREVICTSRDGDKFWRMPECYIRGSTIKYLRIPDEIIDMVKEEVVA

SEQ ID NO: 47315 - protein, 238 aa, Homo sapiens
  Payload ID: 9587
  Gene Symbol: LSM4
  Gene Name: LSM4 homolog, U6 small nuclear RNA and mRNA degradation associated
  ENSP ID: ENSP00000477443
MLPLSLLKTAQNHPMLVELKNGETYNGHLVSCDNWMNINLREVICTSRDGDKFWRMPECYIRGSTIKYLRIPDEIIDMVKEEVVAKGRGRGGLQQQKQQKGRGMGGAGRGGSPLSSGRTWGGKTATRGIPPSWGCPCSAASEPPNPPGPPSWSLAMSRGPGRGAPRPGTQPSSHCASWRSSGHIKSPPQASVSPLRGYGGAHLSRPLATPLGTWRGSIQSQGRPPPPEMMNWHKIPFV

SEQ ID NO: 47316 - protein, 71 aa, Homo sapiens
  Payload ID: 9588
  Gene Symbol: LSM5
  Gene Name: LSM5 homolog, U6 small nuclear RNA and mRNA degradation associated
  ENSP ID: ENSP00000223084
MAANATTNPSQLLPLGNRRPLGSRNRELTFRIGGRGAVPRQALAECGEMYKTKCGSTLSSKSSRQQAAPAL

SEQ ID NO: 47317 - protein, 64 aa, Homo sapiens
  Payload ID: 9588
  Gene Symbol: LSM5
  Gene Name: LSM5 homolog, U6 small nuclear RNA and mRNA degradation associated
  ENSP ID: ENSP00000386275
MAANATTNPSQLLPLELVDKCIGSRIHIVMKSDKEIVGTLLGFDDFVSILLKVKSHQKEEGLLN

SEQ ID NO: 47318 - protein, 62 aa, Homo sapiens
  Payload ID: 9588
  Gene Symbol: LSM5
  Gene Name: LSM5 homolog, U6 small nuclear RNA and mRNA degradation associated
  Uniprot ID: Q9Y4Y9
  ENSP ID: ENSP00000386363
MKSDKEIVGTLLGFDDFVNMVLEDVTEFEITPEGRRITKLDQILLNGNNITMLVPGGEGPEV

SEQ ID NO: 47319 - protein, 62 aa, Homo sapiens; identical to SEQ ID NO: 47318
  Payload ID: 9588
  Gene Symbol: LSM5
  Gene Name: LSM5 homolog, U6 small nuclear RNA and mRNA degradation associated
  Uniprot ID: Q9Y4Y9
  ENSP ID: ENSP00000386707

SEQ ID NO: 47320 - protein, 62 aa, Homo sapiens; identical to SEQ ID NO: 47318
  Payload ID: 9588
  Gene Symbol: LSM5
  Gene Name: LSM5 homolog, U6 small nuclear RNA and mRNA degradation associated
  Uniprot ID: Q9Y4Y9
  ENSP ID: ENSP00000386814

SEQ ID NO: 47321 - protein, 62 aa, Homo sapiens; identical to SEQ ID NO: 47318
  Payload ID: 9588
  Gene Symbol: LSM5
  Gene Name: LSM5 homolog, U6 small nuclear RNA and mRNA degradation associated
  Uniprot ID: Q9Y4Y9
  ENSP ID: ENSP00000387109

SEQ ID NO: 47322 - protein, 62 aa, Homo sapiens; identical to SEQ ID NO: 47318
  Payload ID: 9588
  Gene Symbol: LSM5
  Gene Name: LSM5 homolog, U6 small nuclear RNA and mRNA degradation associated
  Uniprot ID: Q9Y4Y9
  ENSP ID: ENSP00000387126

SEQ ID NO: 47323 - protein, 91 aa, Homo sapiens
  Payload ID: 9588
  Gene Symbol: LSM5
  Gene Name: LSM5 homolog, U6 small nuclear RNA and mRNA degradation associated
  Uniprot ID: Q9Y4Y9
  ENSP ID: ENSP00000410758
MAANATTNPSQLLPLELVDKCIGSRIHIVMKSDKEIVGTLLGFDDFVNMVLEDVTEFEITPEGRRITKLDQILLNGNNITMLVPGGEGPEV

SEQ ID NO: 47324 - protein, 80 aa, Homo sapiens
  Payload ID: 9589
  Gene Symbol: LSM6
  Gene Name: LSM6 homolog, U6 small nuclear RNA and mRNA degradation associated
  Uniprot ID: P62312
  ENSP ID: ENSP00000296581
MSLRKQTPSDFLKQIIGRPVVVKLNSGVDYRGVLACLDGYMNIALEQTEEYVNGQLKNKYGDAFIRGNNVLYISTQKRRM

SEQ ID NO: 47325 - protein, 80 aa, Homo sapiens; identical to SEQ ID NO: 47324
  Payload ID: 9589
  Gene Symbol: LSM6
  Gene Name: LSM6 homolog, U6 small nuclear RNA and mRNA degradation associated
  Uniprot ID: P62312
  ENSP ID: ENSP00000420929

SEQ ID NO: 47326 - protein, 80 aa, Homo sapiens; identical to SEQ ID NO: 47324
  Payload ID: 9589
  Gene Symbol: LSM6
  Gene Name: LSM6 homolog, U6 small nuclear RNA and mRNA degradation associated
  Uniprot ID: P62312
  ENSP ID: ENSP00000422392

SEQ ID NO: 47327 - protein, 80 aa, Homo sapiens; identical to SEQ ID NO: 47324
  Payload ID: 9589
  Gene Symbol: LSM6
  Gene Name: LSM6 homolog, U6 small nuclear RNA and mRNA degradation associated
  Uniprot ID: P62312
  ENSP ID: ENSP00000427036

SEQ ID NO: 47328 - protein, 103 aa, Homo sapiens
  Payload ID: 9590
  Gene Symbol: LSM7
  Gene Name: LSM7 homolog, U6 small nuclear RNA and mRNA degradation associated
  Uniprot ID: Q9UK45
  ENSP ID: ENSP00000252622
MADKEKKKKESILDLSKYIDKTIRVKFQGGREASGILKGFDPLLNLVLDGTIEYMRDPDDQYKLTEDTRQLGLVVCRGTSVVLICPQDGMEAIPNPFIQQQDA

SEQ ID NO: 47329 - protein, 60 aa, Homo sapiens
  Payload ID: 9590
  Gene Symbol: LSM7
  Gene Name: LSM7 homolog, U6 small nuclear RNA and mRNA degradation associated
  ENSP ID: ENSP00000466556
DKEKKKKESILDLSKYIDKTIRVKFQGGREESQALAHTPEEGHLGSMLETYLPQCSHLSP

SEQ ID NO: 47330 - protein, 35 aa, Homo sapiens
  Payload ID: 9590
  Gene Symbol: LSM7
  Gene Name: LSM7 homolog, U6 small nuclear RNA and mRNA degradation associated
  ENSP ID: ENSP00000467145
MADKEKKKKESILDLSKYIDKTIRVKFQGGREVES

SEQ ID NO: 47331 - protein, 49 aa, Homo sapiens
  Payload ID: 9590
  Gene Symbol: LSM7
  Gene Name: LSM7 homolog, U6 small nuclear RNA and mRNA degradation associated
  ENSP ID: ENSP00000485007
MRDPDDQYKLTEDTRQLGLVVCRGTSVVLICPQDGMEAIPNPFIQQQDA

SEQ ID NO: 47332 - protein, 96 aa, Homo sapiens
  Payload ID: 9591
  Gene Symbol: LSM8
  Gene Name: LSM8 homolog, U6 small nuclear RNA associated
  Uniprot ID: O95777
  ENSP ID: ENSP00000249299
MTSALENYINRTVAVITSDGRMIVGTLKGFDQTINLILDESHERVFSSSQGVEQVVLGLYIVRGDNVAVIGEIDEETDSALDLGNIRAEPLNSVAH

SEQ ID NO: 47333 - protein, 67 aa, Homo sapiens
  Payload ID: 9591
  Gene Symbol: LSM8
  Gene Name: LSM8 homolog, U6 small nuclear RNA associated
  ENSP ID: ENSP00000395263
MTSALENYINRTVAVITSDGRMIVGTLKGFDQTINLILDESHERVFSSSQGVEQVVLGLYIVRGDNV

SEQ ID NO: 47334 - protein, 75 aa, Homo sapiens
  Payload ID: 9591
  Gene Symbol: LSM8
  Gene Name: LSM8 homolog, U6 small nuclear RNA associated
  ENSP ID: ENSP00000403811
MIVGTLKGFDQTINLILDESHERVFSSSQGVEQVVLGLYIVRGDNVAVIGEIDEETDSALDLGNIRAEPLNSVAH

SEQ ID NO: 47335 - protein, 77 aa, Homo sapiens
  Payload ID: 9591
  Gene Symbol: LSM8
  Gene Name: LSM8 homolog, U6 small nuclear RNA associated
  ENSP ID: ENSP00000408267
MTSALENYINRILKLAAAGLSGTVAVITSDGRMIVGTLKGFDQTINLILDESHERVFSSSQGVEQVVLGLYIVRGDN

SEQ ID NO: 47336 - protein, 475 aa, Homo sapiens
  Payload ID: 9592
  Gene Symbol: LTV1
  Gene Name: LTV1 ribosome biogenesis factor
  Uniprot ID: Q96GA3
  ENSP ID: ENSP00000356548
MPHRKKKPFIEKKKAVSFHLVHRSQRDPLAADESAPQRVLLPTQKIDNEERRAEQRKYGVFFDDDYDYLQHLKEPSGPSELIPSSTFSAHNRREEKEETLVIPSTGIKLPSSVFASEFEEDVGLLNKAAPVSGPRLDFDPDIVAALDDDFDFDDPDNLLEDDFILQANKATGEEEGMDIQKSENEDDSEWEDVDDEKGDSNDDYDSAGLLSDEDCMSVPGKTHRAIADHLFWSEETKSRFTEYSMTSSVMRRNEQLTLHDERFEKFYEQYDDDEIGALDNAELEGSIQVDSNRLQEVLNDYYKEKAENCVKLNTLEPLEDQDLPMNELDESEEEEMITVVLEEAKEKWDCESICSTYSNLYNHPQLIKYQPKPKQIRISSKTGIPLNVLPKKGLTAKQTERIQMINGSDLPKVSTQPRSKNESKEDKRARKQAIKEERKERRVEKKANKLAFKLEKRRQEKELLNLKKNVEGLKL

SEQ ID NO: 47337 - protein, 371 aa, Homo sapiens
  Payload ID: 9593
  Gene Symbol: LUC7L
  Gene Name: LUC7-like
  Uniprot ID: Q9NQ29
  ENSP ID: ENSP00000293872
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYKFSRERASREESWESGRSERGPPDWRLESSNGKMASRRSEEKEAGEI

SEQ ID NO: 47338 - protein, 325 aa, Homo sapiens
  Payload ID: 9593
  Gene Symbol: LUC7L
  Gene Name: LUC7-like
  Uniprot ID: Q9NQ29
  ENSP ID: ENSP00000337507
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYK

SEQ ID NO: 47339 - protein, 272 aa, Homo sapiens
  Payload ID: 9593
  Gene Symbol: LUC7L
  Gene Name: LUC7-like
  ENSP ID: ENSP00000380882
MDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYK

SEQ ID NO: 47340 - protein, 325 aa, Homo sapiens; identical to SEQ ID NO: 47338
  Payload ID: 9593
  Gene Symbol: LUC7L
  Gene Name: LUC7-like
  Uniprot ID: Q9NQ29
  ENSP ID: ENSP00000380885

SEQ ID NO: 47341 - protein, 42 aa, Homo sapiens
  Payload ID: 9593
  Gene Symbol: LUC7L
  Gene Name: LUC7-like
  ENSP ID: ENSP00000390953
MSAQAQMRALLDQLMGTARDGESERPTRRGSGVGVRRGRRAA

SEQ ID NO: 47342 - protein, 55 aa, Homo sapiens
  Payload ID: 9593
  Gene Symbol: LUC7L
  Gene Name: LUC7-like
  ENSP ID: ENSP00000393551
MSAQAQMRALLDQLMGTARDGSVYLCLPTSICKGVAESLMFIEPRRNQTEGQVYR

SEQ ID NO: 47343 - protein, 182 aa, Homo sapiens
  Payload ID: 9593
  Gene Symbol: LUC7L
  Gene Name: LUC7-like
  ENSP ID: ENSP00000406695
MDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRR

SEQ ID NO: 47344 - protein, 60 aa, Homo sapiens
  Payload ID: 9593
  Gene Symbol: LUC7L
  Gene Name: LUC7-like
  ENSP ID: ENSP00000407781
  MOD_RES (1)..(1): Any amino acid
XRRRSRSRDRRRRRSRSTSRERRKLSRSRSRDRHRRHRSRSRSHSRGHRRASRDRSAKYK

SEQ ID NO: 47345 - protein, 32 aa, Homo sapiens
  Payload ID: 9593
  Gene Symbol: LUC7L
  Gene Name: LUC7-like
  ENSP ID: ENSP00000409977
MDLGECTKIHDLALRADYEIASKERDLFFELD

SEQ ID NO: 47346 - protein, 170 aa, Homo sapiens
  Payload ID: 9593
  Gene Symbol: LUC7L
  Gene Name: LUC7-like
  ENSP ID: ENSP00000413033
LGAEGNVDESQKILMEVEKVRAKKKEAEKTVAEKQEKRNQDRLRRREEREREERLSRRSGSRTRDRRRSRSRDRRRRRSRSTSRERRKLSRSRSRDRHRRHRSRSRSHSRGHRRASRDRSAKYKFSRERASREESWESGRSERGPPDWRLESSNGKMASRRSEEKEAGEI

SEQ ID NO: 47347 - protein, 84 aa, Homo sapiens
  Payload ID: 9593
  Gene Symbol: LUC7L
  Gene Name: LUC7-like
  ENSP ID: ENSP00000414508
MDHLESFIAECDRRTELAKKRLAETQEEISAEVSAKAEKVHELNEEIGKLLAKAEQLGAEGNVDESQKILMEVEKVRAKKKEAE

SEQ ID NO: 47348 - protein, 55 aa, Homo sapiens; identical to SEQ ID NO: 47342
  Payload ID: 9593
  Gene Symbol: LUC7L
  Gene Name: LUC7-like
  ENSP ID: ENSP00000414860

SEQ ID NO: 47349 - protein, 55 aa, Homo sapiens; identical to SEQ ID NO: 47342
  Payload ID: 9593
  Gene Symbol: LUC7L
  Gene Name: LUC7-like
  ENSP ID: ENSP00000485761

SEQ ID NO: 47350 - protein, 389 aa, Homo sapiens
  Payload ID: 9594
  Gene Symbol: LUC7L2
  Gene Name: LUC7-like 2 pre-mRNA splicing factor
  ENSP ID: ENSP00000263545
MVIHSQLKKIQGASERMGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 47351 - protein, 392 aa, Homo sapiens
  Payload ID: 9594
  Gene Symbol: LUC7L2
  Gene Name: LUC7-like 2 pre-mRNA splicing factor
  Uniprot ID: Q9Y383
  ENSP ID: ENSP00000347005
MSAQAQMRAMLDQLMGTSRDGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 47352 - protein, 83 aa, Homo sapiens
  Payload ID: 9594
  Gene Symbol: LUC7L2
  Gene Name: LUC7-like 2 pre-mRNA splicing factor
  ENSP ID: ENSP00000393012
MSAQAQMRAMLDQLMGTSRDGSMYLCLPTSICKGVSERPRIRQAEIQLVNESNSVMTEYARVTFSTVVLMMSFLELEWILENV

SEQ ID NO: 47353 - protein, 389 aa, Homo sapiens; identical to SEQ ID NO: 47350
  Payload ID: 9594
  Gene Symbol: LUC7L2
  Gene Name: LUC7-like 2 pre-mRNA splicing factor
  ENSP ID: ENSP00000441604

SEQ ID NO: 47354 - protein, 54 aa, Homo sapiens
  Payload ID: 9594
  Gene Symbol: LUC7L2
  Gene Name: LUC7-like 2 pre-mRNA splicing factor
  ENSP ID: ENSP00000477492
MSAQAQMRAMLDQLMGTSRDGSMYLCLPTSICKGVSERPRIRQAQKGDTSAGTK

SEQ ID NO: 47355 - protein, 391 aa, Homo sapiens
  Payload ID: 9594
  Gene Symbol: LUC7L2
  Gene Name: LUC7-like 2 pre-mRNA splicing factor
  ENSP ID: ENSP00000483438
MPAYLNLQGSVRKAPHSPSRDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 47356 - protein, 432 aa, Homo sapiens
  Payload ID: 9595
  Gene Symbol: LUC7L3
  Gene Name: LUC7-like 3 pre-mRNA splicing factor
  Uniprot ID: O95232
  ENSP ID: ENSP00000240304
MISAAQLLDELMGRDRNLAPDEKRSNVRWDHESVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSEGDTQSN

SEQ ID NO: 47357 - protein, 489 aa, Homo sapiens
  Payload ID: 9595
  Gene Symbol: LUC7L3
  Gene Name: LUC7-like 3 pre-mRNA splicing factor
  ENSP ID: ENSP00000376919
MISAAQLLDELMGRDRNLAPDEKRSNVRWDHESVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSEVQRKYAQMKMELSRVRRHTKASSEGKDSVVLQNILRYIVLSQLFCSRLVPPLVCLFGNYRPHL

SEQ ID NO: 47358 - protein, 184 aa, Homo sapiens
  Payload ID: 9595
  Gene Symbol: LUC7L3
  Gene Name: LUC7-like 3 pre-mRNA splicing factor
  ENSP ID: ENSP00000420933
MISAAQLLDELMGRDRNLAPDEKRSNVRWDHESSTGFCHIGQAGLELLTSSDRSASVSQSAEVTGVSHCARLAFPTLLHSKIVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDK

SEQ ID NO: 47359 - protein, 54 aa, Homo sapiens
  Payload ID: 9595
  Gene Symbol: LUC7L3
  Gene Name: LUC7-like 3 pre-mRNA splicing factor
  ENSP ID: ENSP00000421213
MISAAQLLDELMGRDRNLAPDEKRSNVRWDHESVRVKKFMMKIYENSMRRALVS

SEQ ID NO: 47360 - protein, 39 aa, Homo sapiens
  Payload ID: 9595
  Gene Symbol: LUC7L3
  Gene Name: LUC7-like 3 pre-mRNA splicing factor
  ENSP ID: ENSP00000423556
RSNVRWDHESVCKYYLCGFCPAELFTNTRSDLEEKRILL

SEQ ID NO: 47361 - protein, 79 aa, Homo sapiens
  Payload ID: 9595
  Gene Symbol: LUC7L3
  Gene Name: LUC7-like 3 pre-mRNA splicing factor
  ENSP ID: ENSP00000424767
MISAAQLLDELMGRDRNLAPDEKRSNVRWDHESVCKYYLCGFCPAELFTNTRSDLDVFGRGDNIRDVSKFLEDDKWMEE

SEQ ID NO: 47362 - protein, 79 aa, Homo sapiens; identical to SEQ ID NO: 47361
  Payload ID: 9595
  Gene Symbol: LUC7L3
  Gene Name: LUC7-like 3 pre-mRNA splicing factor
  ENSP ID: ENSP00000424788

SEQ ID NO: 47363 - protein, 432 aa, Homo sapiens; identical to SEQ ID NO: 47356
  Payload ID: 9595
  Gene Symbol: LUC7L3
  Gene Name: LUC7-like 3 pre-mRNA splicing factor
  Uniprot ID: O95232
  ENSP ID: ENSP00000425092

SEQ ID NO: 47364 - protein, 79 aa, Homo sapiens; identical to SEQ ID NO: 47361
  Payload ID: 9595
  Gene Symbol: LUC7L3
  Gene Name: LUC7-like 3 pre-mRNA splicing factor
  ENSP ID: ENSP00000425251

SEQ ID NO: 47365 - protein, 36 aa, Homo sapiens
  Payload ID: 9595
  Gene Symbol: LUC7L3
  Gene Name: LUC7-like 3 pre-mRNA splicing factor
  ENSP ID: ENSP00000426123
MKVGYERDFLRYLQSLLAEVERRIRRGHARLALSQN

SEQ ID NO: 47366 - protein, 207 aa, Homo sapiens
  Payload ID: 9595
  Gene Symbol: LUC7L3
  Gene Name: LUC7-like 3 pre-mRNA splicing factor
  ENSP ID: ENSP00000426371
SFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKGQKIRLLD

SEQ ID NO: 47367 - protein, 79 aa, Homo sapiens; identical to SEQ ID NO: 47361
  Payload ID: 9595
  Gene Symbol: LUC7L3
  Gene Name: LUC7-like 3 pre-mRNA splicing factor
  ENSP ID: ENSP00000426488

SEQ ID NO: 47368 - protein, 123 aa, Homo sapiens
  Payload ID: 9595
  Gene Symbol: LUC7L3
  Gene Name: LUC7-like 3 pre-mRNA splicing factor
  ENSP ID: ENSP00000427927
  MOD_RES (1)..(1): Any amino acid
XRRSKSRDRKSYKHRSKSRDREQDRKSKEKEKRGSDDKKSSVKSGSREKQSEDTNTESKESDTKNEVNGTSEDIKSEVQRKYAQMKMELSRVRRHTKASSEGKDSVVLQNILRTTVRRFLEEY

SEQ ID NO: 47369 - protein, 86 aa, Homo sapiens
  Payload ID: 9595
  Gene Symbol: LUC7L3
  Gene Name: LUC7-like 3 pre-mRNA splicing factor
  ENSP ID: ENSP00000428225
  MOD_RES (1)..(1): Any amino acid
XRSERKHRSRSRDRRRSKSRDRKSYKHRSKSRDREQDRKSKEKVQRKYAQMKMELSRVRRHTKASSEGKDSVVLQNILSVGVVSGP

SEQ ID NO: 47370 - protein, 107 aa, Homo sapiens
  Payload ID: 9595
  Gene Symbol: LUC7L3
  Gene Name: LUC7-like 3 pre-mRNA splicing factor
  ENSP ID: ENSP00000428293
RSRSRHSSRTSDRRCSRSRDHKRSRSRERRRSRSRDRRRSRSHDRSERKHRSRSRDRRRSKSRDRKSYKHRSKSRDREQDRKSKEKEDKIIGLTTSPLRDNKTTLPH

SEQ ID NO: 47371 - protein, 118 aa, Homo sapiens
  Payload ID: 9595
  Gene Symbol: LUC7L3
  Gene Name: LUC7-like 3 pre-mRNA splicing factor
  ENSP ID: ENSP00000430407
  MOD_RES (1)..(1): Any amino acid
XSKSRDRKSYKHRSKSRDREQDRKSKEKEKRGSDDKKSSVKSGSREKQSEDTNTESKESDTKNEVNGTSEDIKSEVQRKYAQMKMELSRVRRHTKASSEGKDSVVLQNILSVGVVSGP

SEQ ID NO: 47372 - protein, 46 aa, Homo sapiens
  Payload ID: 9595
  Gene Symbol: LUC7L3
  Gene Name: LUC7-like 3 pre-mRNA splicing factor
  ENSP ID: ENSP00000476198
MKVGYERDFLRYLQSLLAEVERRIRRGHARLALSQNQQSSGAAGPT

SEQ ID NO: 47373 - protein, 79 aa, Homo sapiens; identical to SEQ ID NO: 47361
  Payload ID: 9595
  Gene Symbol: LUC7L3
  Gene Name: LUC7-like 3 pre-mRNA splicing factor
  ENSP ID: ENSP00000486238

SEQ ID NO: 47374 - protein, 338 aa, Homo sapiens
  Payload ID: 9596
  Gene Symbol: LUM
  Gene Name: lumican
  Uniprot ID: P51884
  ENSP ID: ENSP00000266718
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLILDHNLLENSKIKGRVFSKLKQLKKLHINHNNLTESVGPLPKSLEDLQLTHNKITKLGSFEGLVNLTFIHLQHNRLKEDAVSAAFKGLKSLEYLDLSFNQIARLPSGLPVSLLTLYLDNNKISNIPDEYFKRFNALQYLRLSHNELADSGIPGNSFNVSSLVELDLSYNKLKNIPTVNENLENYYLEVNQLEKFDIKSFCKILGPLSYSKIKHLRLDGNRISETSLPPDMYECLRVANEVTLN

SEQ ID NO: 47375 - protein, 141 aa, Homo sapiens
  Payload ID: 9597
  Gene Symbol: LHB
  Gene Name: luteinizing hormone beta polypeptide
  Uniprot ID: P01229
  ENSP ID: ENSP00000221421
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFL

SEQ ID NO: 47376 - protein, 154 aa, Homo sapiens
  Payload ID: 9597
  Gene Symbol: LHB
  Gene Name: luteinizing hormone beta polypeptide
  ENSP ID: ENSP00000375742
MLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQQASSSSKDPPRSLPSPSRLLEP

SEQ ID NO: 47377 - protein, 699 aa, Homo sapiens
  Payload ID: 9598
  Gene Symbol: LHCGR
  Gene Name: luteinizing hormone/choriogonadotropin receptor
  Uniprot ID: P22888
  ENSP ID: ENSP00000294954
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 47378 - protein, 325 aa, Homo sapiens
  Payload ID: 9598
  Gene Symbol: LHCGR
  Gene Name: luteinizing hormone/choriogonadotropin receptor
  ENSP ID: ENSP00000385406
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLSKPRINGYQ

SEQ ID NO: 47379 - protein, 329 aa, Homo sapiens
  Payload ID: 9598
  Gene Symbol: LHCGR
  Gene Name: luteinizing hormone/choriogonadotropin receptor
  ENSP ID: ENSP00000385847
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLLLHGALSAAHSLS

SEQ ID NO: 47380 - protein, 672 aa, Homo sapiens
  Payload ID: 9598
  Gene Symbol: LHCGR
  Gene Name: luteinizing hormone/choriogonadotropin receptor
  ENSP ID: ENSP00000386033
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKDYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 47381 - protein, 175 aa, Homo sapiens
  Payload ID: 9598
  Gene Symbol: LHCGR
  Gene Name: luteinizing hormone/choriogonadotropin receptor
  ENSP ID: ENSP00000403748
NCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLPWQNCDEAIKELTLKEKRENMDWNDSEMKR

SEQ ID NO: 47382 - protein, 379 aa, Homo sapiens
  Payload ID: 9599
  Gene Symbol: LYAR
  Gene Name: Ly1 antibody reactive
  Uniprot ID: Q9NX58
  ENSP ID: ENSP00000345917
MVFFTCNACGESVKKIQVEKHVSVCRNCECLSCIDCGKDFWGDDYKNHVKCISEDQKYGGKGYEGKTHKGDIKQQAWIQKISELIKRPNVSPKVRELLEQISAFDNVPRKKAKFQNWMKNSLKVHNESILDQVWNIFSEASNSEPVNKEQDQRPLHPVANPHAEISTKVPASKVKDAVEQQGEVKKNKRERKEERQKKRKREKKELKLENHQENSRNQKPKKRKKGQEADLEAGGEEVPEANGSAGKRSKKKKQRKDSASEEEARVGAGKRKRRHSEVETDSKKKKMKLPEHPEGGEPEDDEAPAKGKFNWKGTIKAILKQAPDNEITIKKLRKKVLAQYYTVTDEHHRSEEELLVIFNKKISKNPTFKLLKDKVKLVK

SEQ ID NO: 47383 - protein, 379 aa, Homo sapiens; identical to SEQ ID NO: 47382
  Payload ID: 9599
  Gene Symbol: LYAR
  Gene Name: Ly1 antibody reactive
  Uniprot ID: Q9NX58
  ENSP ID: ENSP00000397367

SEQ ID NO: 47384 - protein, 79 aa, Homo sapiens
  Payload ID: 9599
  Gene Symbol: LYAR
  Gene Name: Ly1 antibody reactive
  ENSP ID: ENSP00000420902
MVFFTCNACGESVKKIQVEKHVSVCRNCECLSCIDCGKDFWGDDYKNHVKCISEDQKYGGKGYEGKTHKGDIKQQAWIQ

SEQ ID NO: 47385 - protein, 97 aa, Homo sapiens
  Payload ID: 9600
  Gene Symbol: LYNX1
  Gene Name: Ly6/neurotoxin 1
  Uniprot ID: Q9BZG9
  ENSP ID: ENSP00000319846
MQLGTGLLLAAVLSLQLAAAEAIWCHQCTGFGGCSHGSRCLRDSTHCVTTATRVLSNTEDLPLVTKMCHIGCPDIPSLGLGPYVSIACCQTSLCNHD

SEQ ID NO: 47386 - protein, 87 aa, Homo sapiens
  Payload ID: 9600
  Gene Symbol: LYNX1
  Gene Name: Ly6/neurotoxin 1
  ENSP ID: ENSP00000428465
LLAAVLSLQLAAAEAIWCHQCTGFGGCSHGSRCLRDSTHCVTTATRPRTLSPHSPHSLAPGLTAAPPSRLASPPLPASAATVQHRLS

SEQ ID NO: 47387 - protein, 82 aa, Homo sapiens
  Payload ID: 9600
  Gene Symbol: LYNX1
  Gene Name: Ly6/neurotoxin 1
  ENSP ID: ENSP00000428713
MTPLLTLILVVLMGLPLAQALDCHVCAYNGDNCFNPMRCPAMVAYCMTTRTYYTPTRMKLQPKPYGVTSARASEGAPMDPDA

SEQ ID NO: 47388 - protein, 116 aa, Homo sapiens
  Payload ID: 9600
  Gene Symbol: LYNX1
  Gene Name: Ly6/neurotoxin 1
  Uniprot ID: Q9BZG9
  ENSP ID: ENSP00000477648
MTPLLTLILVVLMGLPLAQALDCHVCAYNGDNCFNPMRCPAMVAYCMTTRTYYTPTRMKVSKSCVPRCFETVYDGYSKHASTTSCCQYDLCNGTGLATPATLALAPILLATLWGLL

SEQ ID NO: 47389 - protein, 116 aa, Homo sapiens; identical to SEQ ID NO: 47388
  Payload ID: 9600
  Gene Symbol: LYNX1
  Gene Name: Ly6/neurotoxin 1
  Uniprot ID: Q9BZG9
  ENSP ID: ENSP00000478390

SEQ ID NO: 47390 - protein, 116 aa, Homo sapiens; identical to SEQ ID NO: 47388
  Payload ID: 9600
  Gene Symbol: LYNX1
  Gene Name: Ly6/neurotoxin 1
  Uniprot ID: Q9BZG9
  ENSP ID: ENSP00000478402

SEQ ID NO: 47391 - protein, 131 aa, Homo sapiens
  Payload ID: 9600
  Gene Symbol: LYNX1
  Gene Name: Ly6/neurotoxin 1
  Uniprot ID: Q9BZG9
  ENSP ID: ENSP00000479586
MTPLLTLILVVLMGLPLAQALDCHVCAYNGDNCFNPMRCPAMVAYCMTTRTSAAEAIWCHQCTGFGGCSHGSRCLRDSTHCVTTATRVLSNTEDLPLVTKMCHIGCPDIPSLGLGPYVSIACCQTSLCNHD

SEQ ID NO: 47392 - protein, 84 aa, Homo sapiens
  Payload ID: 9600
  Gene Symbol: LYNX1
  Gene Name: Ly6/neurotoxin 1
  ENSP ID: ENSP00000481790
MTPLLTLILVVLMGLPLAQALDCHVCAYNGDNCFNPMRCPAMVAYCMTTRTYYTPTRMKVSKSCVPRCFETVYDGYSKHASTTS

SEQ ID NO: 47393 - protein, 82 aa, Homo sapiens
  Payload ID: 9600
  Gene Symbol: LYNX1
  Gene Name: Ly6/neurotoxin 1
  ENSP ID: ENSP00000482846
MTPLLTLILVVLMGLPLAQALDCHVCAYNGDNCFNPMRCPAMVAYCMTTRTYYTPTRMKVSKSCVPRCFETVYDGYSKHAST

SEQ ID NO: 47394 - protein, 89 aa, Homo sapiens
  Payload ID: 9601
  Gene Symbol: LYPD1
  Gene Name: LY6/PLAUR domain containing 1
  Uniprot ID: Q8N2G4
  ENSP ID: ENSP00000340563
MCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 47395 - protein, 141 aa, Homo sapiens
  Payload ID: 9601
  Gene Symbol: LYPD1
  Gene Name: LY6/PLAUR domain containing 1
  Uniprot ID: Q8N2G4
  ENSP ID: ENSP00000380605
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 47396 - protein, 39 aa, Homo sapiens
  Payload ID: 9601
  Gene Symbol: LYPD1
  Gene Name: LY6/PLAUR domain containing 1
  ENSP ID: ENSP00000396651
MWVLGIAATFCGLFLLPGENTQRPAAEARLCAANPVLPV

SEQ ID NO: 47397 - protein, 125 aa, Homo sapiens
  Payload ID: 9602
  Gene Symbol: LYPD2
  Gene Name: LY6/PLAUR domain containing 2
  Uniprot ID: Q6UXB3
  ENSP ID: ENSP00000352163
MRGTRLALLALVLAACGELAPALRCYVCPEPTGVSDCVTIATCTTNETMCKTTLYSREIVYPFQGDSTVTKSCASKCKPSDVDGIGQTLPVSCCNTELCNVDGAPALNSLHCGALTLLPLLSLRL

SEQ ID NO: 47398 - protein, 346 aa, Homo sapiens [sequence omitted]

SEQ ID NO: 47399 - protein, 211 aa, Homo sapiens
  Payload ID: 9604
  Gene Symbol: LYPD4
  Gene Name: LY6/PLAUR domain containing 4
  Uniprot ID: Q6UWN0
  ENSP ID: ENSP00000339568
MGPQHLRLVQLFCLLGAISTLPRMSCGAGCYKTQKGTARGVVGFKGCSSSSSYPAQISYLVSPPGVSIASYSRVCRSYLCNNLTNLEPFVKLKASTPKSITSASCSCPTCVGEHMKDCLPNFVTTNSCPLAASTCYSSTLKFQAGFLNTTFLLMGCAREHNQLLADFHHIGSIKVTEVLNILEKSQIVGAASSRQDPAWGVVLGLLFAFRD

SEQ ID NO: 47400 - protein, 211 aa, Homo sapiens; identical to SEQ ID NO: 47399
  Payload ID: 9604
  Gene Symbol: LYPD4
  Gene Name: LY6/PLAUR domain containing 4
  Uniprot ID: Q6UWN0
  ENSP ID: ENSP00000472570

SEQ ID NO: 47401 - protein, 246 aa, Homo sapiens
  Payload ID: 9604
  Gene Symbol: LYPD4
  Gene Name: LY6/PLAUR domain containing 4
  Uniprot ID: Q6UWN0
  ENSP ID: ENSP00000476510
MGPQHLRLVQLFCLLGAISTLPRAGALLCYEATASRFRAVAFHNWKWLLMRNMVCKLQEGCEETLVFIETGTARGVVGFKGCSSSSSYPAQISYLVSPPGVSIASYSRVCRSYLCNNLTNLEPFVKLKASTPKSITSASCSCPTCVGEHMKDCLPNFVTTNSCPLAASTCYSSTLKFQAGFLNTTFLLMGCAREHNQLLADFHHIGSIKVTEVLNILEKSQIVGAASSRQDPAWGVVLGLLFAFRD

SEQ ID NO: 47402 - protein, 251 aa, Homo sapiens
  Payload ID: 9605
  Gene Symbol: LYPD5
  Gene Name: LY6/PLAUR domain containing 5
  Uniprot ID: Q6UWN5
  ENSP ID: ENSP00000367185
MAMGVPRVILLCLFGAALCLTGSQALQCYSFEHTYFGPFDLRAMKLPSISCPHECFEAILSLDTGYRAPVTLVRKGCWTGPPAGQTQSNADALPPDYSVVRGCTTDKCNAHLMTHDALPNLSQAPDPPTLSGAECYACIGVHQDDCAIGRSRRVQCHQDQTACFQGNGRMTVGNFSVPVYIRTCHRPSCTTEGTTSPWTAIDLQGSCCEGYLCNRKSMTQPFTSASATTPPRALQVLALLLPVLLLVGLSA

SEQ ID NO: 47403 - protein, 208 aa, Homo sapiens
  Payload ID: 9605
  Gene Symbol: LYPD5
  Gene Name: LY6/PLAUR domain containing 5
  Uniprot ID: Q6UWN5
  ENSP ID: ENSP00000408433
MKLPSISCPHECFEAILSLDTGYRAPVTLVRKGCWTGPPAGQTQSNADALPPDYSVVRGCTTDKCNAHLMTHDALPNLSQAPDPPTLSGAECYACIGVHQDDCAIGRSRRVQCHQDQTACFQGNGRMTVGNFSVPVYIRTCHRPSCTTEGTTSPWTAIDLQGSCCEGYLCNRKSMTQPFTSASATTPPRALQVLALLLPVLLLVGLSA

SEQ ID NO: 47404 - protein, 127 aa, Homo sapiens
  Payload ID: 9605
  Gene Symbol: LYPD5
  Gene Name: LY6/PLAUR domain containing 5
  ENSP ID: ENSP00000470163
MKLPSISCPHECFEAILSLDTGYRAPVTLVRKGCWTGPPAGQTQSNADALPPDYSVVRGCTTDKCNAHLMTHDALPNLSQAPDPPTLSGAECYACIGVHQDDCAIGRSRRVQCHQDQTACFQGNGRM

SEQ ID NO: 47405 - protein, 208 aa, Homo sapiens; identical to SEQ ID NO: 47403
  Payload ID: 9605
  Gene Symbol: LYPD5
  Gene Name: LY6/PLAUR domain containing 5
  Uniprot ID: Q6UWN5
  ENSP ID: ENSP00000471692

SEQ ID NO: 47406 - protein, 113 aa, Homo sapiens
  Payload ID: 9605
  Gene Symbol: LYPD5
  Gene Name: LY6/PLAUR domain containing 5
  ENSP ID: ENSP00000471909
MKLPSISCPHECFEAILSLDTGYRAPVTLVRKGCWTGPPAGQTQSNADALPPDYSVVRGCTTDKCNAHLMTHDALPNLSQAPDPPTLSGAECYACIGVHQDDCAIGRSRRVQC

SEQ ID NO: 47407 - protein, 171 aa, Homo sapiens
  Payload ID: 9606
  Gene Symbol: LYPD6
  Gene Name: LY6/PLAUR domain containing 6
  Uniprot ID: Q86Y78
  ENSP ID: ENSP00000334463
MEPGPALAWLLLLSLLADCLKAAQSRDFTVKDIIYLHPSTTPYPGGFKCFTCEKAADNYECNRWAPDIYCPRETRYCYTQHTMEVTGNSISVTKRCVPLEECLSTGCRDSEHEGHKVCTSCCEGNICNLPLPRNETDATFATTSPINQTNGHPRCMSVIVSCLWLWLGLML

SEQ ID NO: 47408 - protein, 76 aa, Homo sapiens
  Payload ID: 9606
  Gene Symbol: LYPD6
  Gene Name: LY6/PLAUR domain containing 6
  Uniprot ID: Q86Y78
  ENSP ID: ENSP00000376594
MEPGPALAWLLLLSLLADCLKAAQSRDFTVKDIIYLHPSTTPYPGGFKCFTCEKAADNYECNRWAPDIYCPRGTMI

SEQ ID NO: 47409 - protein, 171 aa, Homo sapiens; identical to SEQ ID NO: 47407
  Payload ID: 9606
  Gene Symbol: LYPD6
  Gene Name: LY6/PLAUR domain containing 6
  Uniprot ID: Q86Y78
  ENSP ID: ENSP00000386413

SEQ ID NO: 47410 - protein, 53 aa, Homo sapiens
  Payload ID: 9606
  Gene Symbol: LYPD6
  Gene Name: LY6/PLAUR domain containing 6
  ENSP ID: ENSP00000392286
MEPGPALAWLLLLSLLADCLKAAQSRDFTVKDIIYLHPSTTPYPGGFKCFTCE

SEQ ID NO: 47411 - protein, 76 aa, Homo sapiens; identical to SEQ ID NO: 47408
  Payload ID: 9606
  Gene Symbol: LYPD6
  Gene Name: LY6/PLAUR domain containing 6
  Uniprot ID: Q86Y78
  ENSP ID: ENSP00000396855

SEQ ID NO: 47412 - protein, 183 aa, Homo sapiens
  Payload ID: 9607
  Gene Symbol: LYPD6B
  Gene Name: LY6/PLAUR domain containing 6B
  ENSP ID: ENSP00000280115
MRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 47413 - protein, 183 aa, Homo sapiens
  Payload ID: 9607
  Gene Symbol: LYPD6B
  Gene Name: LY6/PLAUR domain containing 6B
  Uniprot ID: Q8NI32
  ENSP ID: ENSP00000386479
MLYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 47414 - protein, 183 aa, Homo sapiens; identical to SEQ ID NO: 47413
  Payload ID: 9607
  Gene Symbol: LYPD6B
  Gene Name: LY6/PLAUR domain containing 6B
  Uniprot ID: Q8NI32
  ENSP ID: ENSP00000386650

SEQ ID NO: 47415 - protein, 207 aa, Homo sapiens
  Payload ID: 9607
  Gene Symbol: LYPD6B
  Gene Name: LY6/PLAUR domain containing 6B
  Uniprot ID: Q8NI32
  ENSP ID: ENSP00000387077
MLLITLSANLFTVPERSLTTTFSFSRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 47416 - protein, 50 aa, Homo sapiens
  Payload ID: 9607
  Gene Symbol: LYPD6B
  Gene Name: LY6/PLAUR domain containing 6B
  ENSP ID: ENSP00000388361
MLCERHCTEEDENHSKPNKGNAEEIFSAEYWKVRFPASRISGNVNEQHEA

SEQ ID NO: 47417 - protein, 54 aa, Homo sapiens
  Payload ID: 9607
  Gene Symbol: LYPD6B
  Gene Name: LY6/PLAUR domain containing 6B
  ENSP ID: ENSP00000410840
MLYKSSDRPAHKVSMLLLCHALAIAVVQIVIFSESWAFAKNINFYNVRPPLDHK

SEQ ID NO: 47418 - protein, 74 aa, Homo sapiens
  Payload ID: 9607
  Gene Symbol: LYPD6B
  Gene Name: LY6/PLAUR domain containing 6B
  ENSP ID: ENSP00000412070
MLLITLSANLFTVPERSLTTTFSFSRCERHCTEEDENHSKPNKGNAEEIFSAEYWKVRFPASRISGNVNEQHEA

SEQ ID NO: 47419 - protein, 54 aa, Homo sapiens
  Payload ID: 9608
  Gene Symbol: LYPD8
  Gene Name: LY6/PLAUR domain containing 8
  ENSP ID: ENSP00000456439
  MOD_RES (1)..(1): Any amino acid
XPPLKNVSSNAECPACYESNGTSCHGKPWKCYEEEQCVFLVAELKNGTPGDGAD

SEQ ID NO: 47420 - protein, 237 aa, Homo sapiens
  Payload ID: 9608
  Gene Symbol: LYPD8
  Gene Name: LY6/PLAUR domain containing 8
  ENSP ID: ENSP00000466070
MKGILVAGITAVLVAAVESLSCVQCNSWEKSCVNSIASECPSHANTSCISSSASSSLETPVRLYQNMFCSAENCSEETHITAFTVHVSAEEHFHFVSQCCQGKECSNTSDALDPPLKNVSSNAECPACYESNGTSCHGKPWKCYEEEQCVFLVAELKNDIESKSLVLKGCSNVSNATCQFLSGENKTLGGVIFRKFECANVNSLTPTSAPTTSHNVGSKASLYLLALASLLLRGLLP

SEQ ID NO: 47421 - protein, 1817 aa, Homo sapiens
  Payload ID: 9609
  Gene Symbol: LY75-CD302
  Gene Name: LY75-CD302 readthrough
  ENSP ID: ENSP00000421035
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 47422 - protein, 1873 aa, Homo sapiens
  Payload ID: 9609
  Gene Symbol: LY75-CD302
  Gene Name: LY75-CD302 readthrough
  ENSP ID: ENSP00000423463
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLDCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 47423 - protein, 322 aa, Homo sapiens
  Payload ID: 9610
  Gene Symbol: LYVE1
  Gene Name: lymphatic vessel endothelial hyaluronan receptor 1
  Uniprot ID: Q9Y5Y7
  ENSP ID: ENSP00000256178
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPTALLVLALLFFGAAAGLGFCYVKRYVKAFPFTNKNQQKEMIETKVVKEEKANDSNPNEESKKTDKNPEESKSPSKTTVRCLEAEV

SEQ ID NO: 47424 - protein, 71 aa, Homo sapiens
  Payload ID: 9610
  Gene Symbol: LYVE1
  Gene Name: lymphatic vessel endothelial hyaluronan receptor 1
  ENSP ID: ENSP00000402580
MARCFSLVLLLTSIWTTRLLVQGSLRAEGSSFLALCSCSAIEMKPSNHFSVQLVCILLQLWLGWRWIRGHL

SEQ ID NO: 47425 - protein, 218 aa, Homo sapiens
  Payload ID: 9610
  Gene Symbol: LYVE1
  Gene Name: lymphatic vessel endothelial hyaluronan receptor 1
  ENSP ID: ENSP00000436016
MARCFSLVLLLTSIWTTRLLVQGSLRAEDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPTALLVLALLFFGAAAGLGFCYVKRYVKAFPFTNKNQQKEMIETKVVKEEKANDSNPNEESKKTDKNPEESKSPSKTTVRCLEAEV

SEQ ID NO: 47426 - protein, 280 aa, Homo sapiens
  Payload ID: 9611
  Gene Symbol: LYL1
  Gene Name: lymphoblastic leukemia associated hematopoiesis regulator 1
  Uniprot ID: P12980
  ENSP ID: ENSP00000264824
MCPPQAQAEVGPTMTEKAEMVCAPSPAPAPPPKPASPGPPQVEEVGHRGGSSPPRLPPGVPVISLGHSRPPGVAMPTTELGTLRPPLLQLSTLGTAPPTLALHYHPHPFLNSVYIGPAGPFSIFPSSRLKRRPSHCELDLAEGHQPQKVARRVFTNSRERWRQQNVNGAFAELRKLLPTHPPDRKLSKNEVLRLAMKYIGFLVRLLRDQAAALAAGPTPPGPRKRPVHRVPDDGARRGSGRRAEAAARSQPAPPADPDGSPGGAARPIKMEQTALSPEVR

SEQ ID NO: 47427 - protein, 57 aa, Homo sapiens
  Payload ID: 9611
  Gene Symbol: LYL1
  Gene Name: lymphoblastic leukemia associated hematopoiesis regulator 1
  ENSP ID: ENSP00000468122
MPTTELGTLRPPLLQLSTLGTAPPTLALHYHPHPFLNSVYIGPAGPFSIFPSSRLKR

SEQ ID NO: 47428 - protein, 128 aa, Homo sapiens
  Payload ID: 9612
  Gene Symbol: LY6D
  Gene Name: lymphocyte antigen 6 complex, locus D
  Uniprot ID: Q14210
  ENSP ID: ENSP00000301263
MRTALLLLAALAVATGPALTLRCHVCTSSSNCKHSVVCPASSRFCKTTNTVEPLRGNLVKKDCAESCTPSYTLQGQVSSGTSSTQCCQEDLCNEKLHNAAPTRTALAHSALSLGLALSLLAVILAPSL

SEQ ID NO: 47429 - protein, 131 aa, Homo sapiens
  Payload ID: 9613
  Gene Symbol: LY6E
  Gene Name: lymphocyte antigen 6 complex, locus E
  Uniprot ID: Q16553
  ENSP ID: ENSP00000292494
MKIFLPVLLAALLGVERASSLMCFSCLNQKSNLYCLKPTICSDQDNYCVTVSASAGIGNLVTFGHSLSKTCSPACPIPEGVNVGVASMGISCCQSFLCNFSAADGGLRASVTLLGAGLLLSLLPALLRFGP

SEQ ID NO: 47430 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000414307

SEQ ID NO: 47431 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000427915

SEQ ID NO: 47432 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000428159

SEQ ID NO: 47433 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000428169

SEQ ID NO: 47434 - protein, 41 aa, Homo sapiens
  Payload ID: 9613
  Gene Symbol: LY6E
  Gene Name: lymphocyte antigen 6 complex, locus E
  ENSP ID: ENSP00000428365
MKIFLPVLLAALLGVEREEQSVLPEADHLLRPGQLLRDCVC

SEQ ID NO: 47435 - protein, 147 aa, Homo sapiens
  Payload ID: 9613
  Gene Symbol: LY6E
  Gene Name: lymphocyte antigen 6 complex, locus E
  ENSP ID: ENSP00000428427
MTSGIPGCGGACVLPSRAPLRRRDPQHCSPTLSEAPLLRAHTQTRLLTRGLPTPNTTRTVQVSVTVTPTWSPVRPRQDRLLWFVTSRQDGHPLQNEDLLASAAGCPSGCGASQLADVLLLLEPEEQSVLPEADHLLRPGQLLRDCVC

SEQ ID NO: 47436 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000428442

SEQ ID NO: 47437 - protein, 66 aa, Homo sapiens
  Payload ID: 9613
  Gene Symbol: LY6E
  Gene Name: lymphocyte antigen 6 complex, locus E
  ENSP ID: ENSP00000428467
MKIFLPVLLAALLGVERASSLMCFSCLNQKSNLYCLKPTICSDQDNYCVTVSASAGIASFPMQGIS

SEQ ID NO: 47438 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000428572

SEQ ID NO: 47439 - protein, 73 aa, Homo sapiens
  Payload ID: 9613
  Gene Symbol: LY6E
  Gene Name: lymphocyte antigen 6 complex, locus E
  ENSP ID: ENSP00000430131
MKIFLPVLLAALLGVERASSLMCFSCLNQKSNLYCLKPTICSDQDNYCVTVSASAGIGECQASDRAFLPWPSP

SEQ ID NO: 47440 - protein, 66 aa, Homo sapiens
  Payload ID: 9613
  Gene Symbol: LY6E
  Gene Name: lymphocyte antigen 6 complex, locus E
  ENSP ID: ENSP00000430700
MKIFLPVLLAALLGVERASSLMCFSCLNQKSNLYCLKPTICSDQDNYCVTVSASAGIGGFAGGTDS

SEQ ID NO: 47441 - protein, 41 aa, Homo sapiens; identical to SEQ ID NO: 47434
  Payload ID: 9613
  Gene Symbol: LY6E
  Gene Name: lymphocyte antigen 6 complex, locus E
  ENSP ID: ENSP00000430770

SEQ ID NO: 47442 - protein, 66 aa, Homo sapiens; identical to SEQ ID NO: 47437
  Payload ID: 9613
  Gene Symbol: LY6E
  Gene Name: lymphocyte antigen 6 complex, locus E
  ENSP ID: ENSP00000430796

SEQ ID NO: 47443 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000482517

SEQ ID NO: 47444 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000487664

SEQ ID NO: 47445 - protein, 66 aa, Homo sapiens; identical to SEQ ID NO: 47437
  Payload ID: 9613
  Gene Symbol: LY6E
  Gene Name: lymphocyte antigen 6 complex, locus E
  ENSP ID: ENSP00000487700

SEQ ID NO: 47446 - protein, 73 aa, Homo sapiens; identical to SEQ ID NO: 47439
  Payload ID: 9613
  Gene Symbol: LY6E
  Gene Name: lymphocyte antigen 6 complex, locus E
  ENSP ID: ENSP00000488115

SEQ ID NO: 47447 - protein, 66 aa, Homo sapiens; identical to SEQ ID NO: 47437
  Payload ID: 9613
  Gene Symbol: LY6E
  Gene Name: lymphocyte antigen 6 complex, locus E
  ENSP ID: ENSP00000488121

SEQ ID NO: 47448 - protein, 147 aa, Homo sapiens; identical to SEQ ID NO: 47435
  Payload ID: 9613
  Gene Symbol: LY6E
  Gene Name: lymphocyte antigen 6 complex, locus E
  ENSP ID: ENSP00000488311

SEQ ID NO: 47449 - protein, 41 aa, Homo sapiens; identical to SEQ ID NO: 47434
  Payload ID: 9613
  Gene Symbol: LY6E
  Gene Name: lymphocyte antigen 6 complex, locus E
  ENSP ID: ENSP00000488414

SEQ ID NO: 47450 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000488421

SEQ ID NO: 47451 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000488443

SEQ ID NO: 47452 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000488556

SEQ ID NO: 47453 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000488559

SEQ ID NO: 47454 - protein, 66 aa, Homo sapiens; identical to SEQ ID NO: 47440
  Payload ID: 9613
  Gene Symbol: LY6E
  Gene Name: lymphocyte antigen 6 complex, locus E
  ENSP ID: ENSP00000488627

SEQ ID NO: 47455 - protein, 41 aa, Homo sapiens; identical to SEQ ID NO: 47434
  Payload ID: 9613
  Gene Symbol: LY6E
  Gene Name: lymphocyte antigen 6 complex, locus E
  ENSP ID: ENSP00000488743

SEQ ID NO: 47456 - protein, 131 aa, Homo sapiens; identical to SEQ ID NO: 47429
  Payload ID: 9613
  Gene Symbol: LY6E
  Gene Name: lymphocyte antigen 6 complex, locus E
  Uniprot ID: Q16553
  ENSP ID: ENSP00000488891

SEQ ID NO: 47457 - protein, 201 aa, Homo sapiens
  Payload ID: 9614
  Gene Symbol: LY6G5B
  Gene Name: lymphocyte antigen 6 complex, locus G5B
  Uniprot ID: Q8NDX9
  ENSP ID: ENSP00000365024
MKVHMLVGVLVMVGFTVGKVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 47458 - protein, 212 aa, Homo sapiens
  Payload ID: 9614
  Gene Symbol: LY6G5B
  Gene Name: lymphocyte antigen 6 complex, locus G5B
  ENSP ID: ENSP00000372921
DFGYCPRVYCENQPMLPIGVLVMVGFTVGKVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELCRMYLFLNSSGLLVLPQAGLLTPHPS

SEQ ID NO: 47459 - protein, 146 aa, Homo sapiens
  Payload ID: 9614
  Gene Symbol: LY6G5B
  Gene Name: lymphocyte antigen 6 complex, locus G5B
  Uniprot ID: Q8NDX9
  ENSP ID: ENSP00000386365
MVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 47460 - protein, 212 aa, Homo sapiens; identical to SEQ ID NO: 47458
  Payload ID: 9614
  Gene Symbol: LY6G5B
  Gene Name: lymphocyte antigen 6 complex, locus G5B
  ENSP ID: ENSP00000395699

SEQ ID NO: 47461 - protein, 212 aa, Homo sapiens; identical to SEQ ID NO: 22403
  Payload ID: 9614
  Gene Symbol: LY6G5B
  Gene Name: lymphocyte antigen 6 complex, locus G5B
  ENSP ID: ENSP00000398952

SEQ ID NO: 47462 - protein, 212 aa, Homo sapiens; identical to SEQ ID NO: 22403
  Payload ID: 9614
  Gene Symbol: LY6G5B
  Gene Name: lymphocyte antigen 6 complex, locus G5B
  ENSP ID: ENSP00000407899

SEQ ID NO: 47463 - protein, 201 aa, Homo sapiens; identical to SEQ ID NO: 47457
  Payload ID: 9614
  Gene Symbol: LY6G5B
  Gene Name: lymphocyte antigen 6 complex, locus G5B
  Uniprot ID: Q8NDX9
  ENSP ID: ENSP00000417055

SEQ ID NO: 47464 - protein, 201 aa, Homo sapiens; identical to SEQ ID NO: 47457
  Payload ID: 9614
  Gene Symbol: LY6G5B
  Gene Name: lymphocyte antigen 6 complex, locus G5B
  Uniprot ID: Q8NDX9
  ENSP ID: ENSP00000417822

SEQ ID NO: 47465 - protein, 201 aa, Homo sapiens; identical to SEQ ID NO: 47457
  Payload ID: 9614
  Gene Symbol: LY6G5B
  Gene Name: lymphocyte antigen 6 complex, locus G5B
  Uniprot ID: Q8NDX9
  ENSP ID: ENSP00000418119

SEQ ID NO: 47466 - protein, 201 aa, Homo sapiens [sequence omitted]

SEQ ID NO: 47467 - protein, 201 aa, Homo sapiens [sequence omitted]

SEQ ID NO: 47468 - protein, 201 aa, Homo sapiens; identical to SEQ ID NO: 47457
  Payload ID: 9614
  Gene Symbol: LY6G5B
  Gene Name: lymphocyte antigen 6 complex, locus G5B
  Uniprot ID: Q8NDX9
  ENSP ID: ENSP00000420698

SEQ ID NO: 47469 - protein, 150 aa, Homo sapiens
  Payload ID: 9615
  Gene Symbol: LY6G5C
  Gene Name: lymphocyte antigen 6 complex, locus G5C
  Uniprot ID: Q5SRR4
  ENSP ID: ENSP00000313380
MRFMAGPAGSQSLGPLCFHSSPQALYTVLLIVLVMMSLVFGKFVPVNWEPPQPLPFPKYLRCYRCLLETKELGCLLGSDICLTPAGSSCITLHKKNSSGSDVMVSDCRSKEQMSDCSNTRTSPVSGFWIFSQYCFLDFCNDPQNRGLYTP

SEQ ID NO: 47470 - protein, 225 aa, Homo sapiens
  Payload ID: 9615
  Gene Symbol: LY6G5C
  Gene Name: lymphocyte antigen 6 complex, locus G5C
  ENSP ID: ENSP00000365023
  MOD_RES (1)..(1): Any amino acid
XADLPSCWGAGPCYTGHKVGALRRDTVICCCRHGDYSTPCLFTPGKPSRNPSPWKRTLWTLSAPWAGPAGWTGEEQNATKTGLITRRPRPLRRRPHPAPASPLPEIIRGNIPRMLGKFVPVNWEPPQPLPFPKYLRCYRCLLETKELGCLLGSDICLTPAGSSCITLHKKNSSGSDVMVSDCRSKEQMSDCSNTRTSPVSGFWIFSQYCFLDFCNDPQNRGLYTP

SEQ ID NO: 47471 - protein, 150 aa, Homo sapiens; identical to SEQ ID NO: 47469
  Payload ID: 9615
  Gene Symbol: LY6G5C
  Gene Name: lymphocyte antigen 6 complex, locus G5C
  Uniprot ID: Q5SRR4
  ENSP ID: ENSP00000372724

SEQ ID NO: 47472 - protein, 150 aa, Homo sapiens; identical to SEQ ID NO: 47469
  Payload ID: 9615
  Gene Symbol: LY6G5C
  Gene Name: lymphocyte antigen 6 complex, locus G5C
  Uniprot ID: Q5SRR4
  ENSP ID: ENSP00000372917

SEQ ID NO: 47473 - protein, 225 aa, Homo sapiens; identical to SEQ ID NO: 47470
  Payload ID: 9615
  Gene Symbol: LY6G5C
  Gene Name: lymphocyte antigen 6 complex, locus G5C
  ENSP ID: ENSP00000389781
  MOD_RES (1)..(1): Any amino acid

SEQ ID NO: 47474 - protein, 150 aa, Homo sapiens; identical to SEQ ID NO: 47469
  Payload ID: 9615
  Gene Symbol: LY6G5C
  Gene Name: lymphocyte antigen 6 complex, locus G5C
  Uniprot ID: Q5SRR4
  ENSP ID: ENSP00000391301

SEQ ID NO: 47475 - protein, 150 aa, Homo sapiens; identical to SEQ ID NO: 47469
  Payload ID: 9615
  Gene Symbol: LY6G5C
  Gene Name: lymphocyte antigen 6 complex, locus G5C
  Uniprot ID: Q5SRR4
  ENSP ID: ENSP00000391878

SEQ ID NO: 47476 - protein, 225 aa, Homo sapiens; identical to SEQ ID NO: 47470
  Payload ID: 9615
  Gene Symbol: LY6G5C
  Gene Name: lymphocyte antigen 6 complex, locus G5C
  ENSP ID: ENSP00000397467
  MOD_RES (1)..(1): Any amino acid

SEQ ID NO: 47477 - protein, 225 aa, Homo sapiens; identical to SEQ ID NO: 47470
  Payload ID: 9615
  Gene Symbol: LY6G5C
  Gene Name: lymphocyte antigen 6 complex, locus G5C
  ENSP ID: ENSP00000400837
  MOD_RES (1)..(1): Any amino acid

SEQ ID NO: 47478 - protein, 225 aa, Homo sapiens; identical to SEQ ID NO: 47470
  Payload ID: 9615
  Gene Symbol: LY6G5C
  Gene Name: lymphocyte antigen 6 complex, locus G5C
  ENSP ID: ENSP00000400950
  MOD_RES (1)..(1): Any amino acid

SEQ ID NO: 47479 - protein, 225 aa, Homo sapiens; identical to SEQ ID NO: 47470
  Payload ID: 9615
  Gene Symbol: LY6G5C
  Gene Name: lymphocyte antigen 6 complex, locus G5C
  ENSP ID: ENSP00000403079
  MOD_RES (1)..(1): Any amino acid

SEQ ID NO: 47480 - protein, 225 aa, Homo sapiens; identical to SEQ ID NO: 47470
  Payload ID: 9615
  Gene Symbol: LY6G5C
  Gene Name: lymphocyte antigen 6 complex, locus G5C
  ENSP ID: ENSP00000410321
  MOD_RES (1)..(1): Any amino acid

SEQ ID NO: 47481 - protein, 150 aa, Homo sapiens; identical to SEQ ID NO: 47469
  Payload ID: 9615
  Gene Symbol: LY6G5C
  Gene Name: lymphocyte antigen 6 complex, locus G5C
  Uniprot ID: Q5SRR4
  ENSP ID: ENSP00000413765

SEQ ID NO: 47482 - protein, 150 aa, Homo sapiens; identical to SEQ ID NO: 47469
  Payload ID: 9615
  Gene Symbol: LY6G5C
  Gene Name: lymphocyte antigen 6 complex, locus G5C
  Uniprot ID: Q5SRR4
  ENSP ID: ENSP00000414953

SEQ ID NO: 47483 - protein, 69 aa, Homo sapiens
  Payload ID: 9615
  Gene Symbol: LY6G5C
  Gene Name: lymphocyte antigen 6 complex, locus G5C
  ENSP ID: ENSP00000418172
MAGPAGSQSLGPLCFHSSPQALYTVLLIVLVMMSLVFGKWLQGFRRVSWPGWRNPQTPSVWVHLSRMLR

SEQ ID NO: 47484 - protein, 125 aa, Homo sapiens
  Payload ID: 9616
  Gene Symbol: LY6G6C
  Gene Name: lymphocyte antigen 6 complex, locus G6C
  Uniprot ID: O95867
  ENSP ID: ENSP00000364978
MKALMLLTLSVLLCWVSADIRCHSCYKVPVLGCVDRQSCRLEPGQQCLTTHAYLGKMWVFSNLRCGTPEEPCQEAFNQTNRKLGLTYNTTCCNKDNCNSAGPRPTPALGLVFLTSLAGLGLWLLH

SEQ ID NO: 47485 - protein, 125 aa, Homo sapiens; identical to SEQ ID NO: 47484
  Payload ID: 9616
  Gene Symbol: LY6G6C
  Gene Name: lymphocyte antigen 6 complex, locus G6C
  Uniprot ID: O95867
  ENSP ID: ENSP00000372905

SEQ ID NO: 47486 - protein, 125 aa, Homo sapiens; identical to SEQ ID NO: 47484
  Payload ID: 9616
  Gene Symbol: LY6G6C
  Gene Name: lymphocyte antigen 6 complex, locus G6C
  Uniprot ID: O95867
  ENSP ID: ENSP00000388591

SEQ ID NO: 47487 - protein, 125 aa, Homo sapiens; identical to SEQ ID NO: 47484
  Payload ID: 9616
  Gene Symbol: LY6G6C
  Gene Name: lymphocyte antigen 6 complex, locus G6C
  Uniprot ID: O95867
  ENSP ID: ENSP00000409428

SEQ ID NO: 47488 - protein, 125 aa, Homo sapiens; identical to SEQ ID NO: 47484
  Payload ID: 9616
  Gene Symbol: LY6G6C
  Gene Name: lymphocyte antigen 6 complex, locus G6C
  Uniprot ID: O95867
  ENSP ID: ENSP00000410398

SEQ ID NO: 47489 - protein, 125 aa, Homo sapiens; identical to SEQ ID NO: 47484
  Payload ID: 9616
  Gene Symbol: LY6G6C
  Gene Name: lymphocyte antigen 6 complex, locus G6C
  Uniprot ID: O95867
  ENSP ID: ENSP00000411365

SEQ ID NO: 47490 - protein, 125 aa, Homo sapiens; identical to SEQ ID NO: 47484
  Payload ID: 9616
  Gene Symbol: LY6G6C
  Gene Name: lymphocyte antigen 6 complex, locus G6C
  Uniprot ID: O95867
  ENSP ID: ENSP00000415732

SEQ ID NO: 47491 - protein, 69 aa, Homo sapiens
  Payload ID: 9616
  Gene Symbol: LY6G6C
  Gene Name: lymphocyte antigen 6 complex, locus G6C
  ENSP ID: ENSP00000431133
MWVFSNLRCGTPEEPCQEAFNQTNRKLGLTYNTTCCNKDNCNSAGPRPTPALGLVFLTSLAGLGLWLLH

SEQ ID NO: 47492 - protein, 69 aa, Homo sapiens; identical to SEQ ID NO: 47491
  Payload ID: 9616
  Gene Symbol: LY6G6C
  Gene Name: lymphocyte antigen 6 complex, locus G6C
  ENSP ID: ENSP00000432319

SEQ ID NO: 47493 - protein, 69 aa, Homo sapiens; identical to SEQ ID NO: 47491
  Payload ID: 9616
  Gene Symbol: LY6G6C
  Gene Name: lymphocyte antigen 6 complex, locus G6C
  ENSP ID: ENSP00000433207

SEQ ID NO: 47494 - protein, 69 aa, Homo sapiens; identical to SEQ ID NO: 47491
  Payload ID: 9616
  Gene Symbol: LY6G6C
  Gene Name: lymphocyte antigen 6 complex, locus G6C
  ENSP ID: ENSP00000433921

SEQ ID NO: 47495 - protein, 69 aa, Homo sapiens; identical to SEQ ID NO: 47491
  Payload ID: 9616
  Gene Symbol: LY6G6C
  Gene Name: lymphocyte antigen 6 complex, locus G6C
  ENSP ID: ENSP00000434057

SEQ ID NO: 47496 - protein, 174 aa, Homo sapiens
  Payload ID: 9617
  Gene Symbol: LY6G6D
  Gene Name: lymphocyte antigen 6 complex, locus G6D
  ENSP ID: ENSP00000364984
MKPQFVGILLSSLLGAALGNRMRCYNCGGSPSSSCKEAVTTCGEGRPQPGLEQIKLPGNRRCFLRGLKIPLGSLKSHLLCPRRQVLKPGVQHPSFILSLSPSDLDSPTSSLRRSPSLQSSGDRVGGRRDLSSPQGLLPGRPVQQRRGKPCGPCRHFGCSSYRPDLSLARTVERI

SEQ ID NO: 47497 - protein, 133 aa, Homo sapiens
  Payload ID: 9617
  Gene Symbol: LY6G6D
  Gene Name: lymphocyte antigen 6 complex, locus G6D
  Uniprot ID: O95868
  ENSP ID: ENSP00000364985
MKPQFVGILLSSLLGAALGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 47498 - protein, 174 aa, Homo sapiens; identical to SEQ ID NO: 47496
  Payload ID: 9617
  Gene Symbol: LY6G6D
  Gene Name: lymphocyte antigen 6 complex, locus G6D
  ENSP ID: ENSP00000372907

SEQ ID NO: 47499 - protein, 133 aa, Homo sapiens; identical to SEQ ID NO: 47497
  Payload ID: 9617
  Gene Symbol: LY6G6D
  Gene Name: lymphocyte antigen 6 complex, locus G6D
  Uniprot ID: O95868
  ENSP ID: ENSP00000382952

SEQ ID NO: 47500 - protein, 382 aa, Homo sapiens
  Payload ID: 9617
  Gene Symbol: LY6G6D
  Gene Name: lymphocyte antigen 6 complex, locus G6D
  ENSP ID: ENSP00000382956
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCTVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 47501 - protein, 133 aa, Homo sapiens; identical to SEQ ID NO: 47497
  Payload ID: 9617
  Gene Symbol: LY6G6D
  Gene Name: lymphocyte antigen 6 complex, locus G6D
  Uniprot ID: O95868
  ENSP ID: ENSP00000389619

SEQ ID NO: 47502 - protein, 174 aa, Homo sapiens; identical to SEQ ID NO: 47496
  Payload ID: 9617
  Gene Symbol: LY6G6D
  Gene Name: lymphocyte antigen 6 complex, locus G6D
  ENSP ID: ENSP00000389642

SEQ ID NO: 47503 - protein, 133 aa, Homo sapiens; identical to SEQ ID NO: 47497
  Payload ID: 9617
  Gene Symbol: LY6G6D
  Gene Name: lymphocyte antigen 6 complex, locus G6D
  Uniprot ID: O95868
  ENSP ID: ENSP00000390777

SEQ ID NO: 47504 - protein, 174 aa, Homo sapiens; identical to SEQ ID NO: 47496
  Payload ID: 9617
  Gene Symbol: LY6G6D
  Gene Name: lymphocyte antigen 6 complex, locus G6D
  ENSP ID: ENSP00000392479

SEQ ID NO: 47505 - protein, 133 aa, Homo sapiens
  Payload ID: 9617
  Gene Symbol: LY6G6D
  Gene Name: lymphocyte antigen 6 complex, locus G6D
  Uniprot ID: O95868
  ENSP ID: ENSP00000392651
MKPQFVGILLSSLLGAALGNRMRCYNCGGSPSSTCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 47506 - protein, 133 aa, Homo sapiens; identical to SEQ ID NO: 47497
  Payload ID: 9617
  Gene Symbol: LY6G6D
  Gene Name: lymphocyte antigen 6 complex, locus G6D
  Uniprot ID: O95868
  ENSP ID: ENSP00000395722

SEQ ID NO: 47507 - protein, 133 aa, Homo sapiens; identical to SEQ ID NO: 47497
  Payload ID: 9617
  Gene Symbol: LY6G6D
  Gene Name: lymphocyte antigen 6 complex, locus G6D
  Uniprot ID: O95868
  ENSP ID: ENSP00000397576

SEQ ID NO: 47508 - protein, 382 aa, Homo sapiens; identical to SEQ ID NO: 22401
  Payload ID: 9617
  Gene Symbol: LY6G6D
  Gene Name: lymphocyte antigen 6 complex, locus G6D
  ENSP ID: ENSP00000397708

SEQ ID NO: 47509 - protein, 382 aa, Homo sapiens; identical to SEQ ID NO: 22401
  Payload ID: 9617
  Gene Symbol: LY6G6D
  Gene Name: lymphocyte antigen 6 complex, locus G6D
  ENSP ID: ENSP00000406832

SEQ ID NO: 47510 - protein, 174 aa, Homo sapiens
  Payload ID: 9617
  Gene Symbol: LY6G6D
  Gene Name: lymphocyte antigen 6 complex, locus G6D
  ENSP ID: ENSP00000408650
MKPQFVGILLSSLLGAALGNRMRCYNCGGSPSSTCKEAVTTCGEGRPQPGLEQIKLPGNRRCFLRGLKIPLGSLKSHLLCPRRQVLKPGVQHPSFILSLSPSDLDSPTSSLRRSPSLQSSGDRVGGRRDLSSPQGLLPGRPVQQRRGKPCGPCRHFGCSSYRPDLSLARTVERI

SEQ ID NO: 47511 - protein, 174 aa, Homo sapiens; identical to SEQ ID NO: 47496
  Payload ID: 9617
  Gene Symbol: LY6G6D
  Gene Name: lymphocyte antigen 6 complex, locus G6D
  ENSP ID: ENSP00000411977

SEQ ID NO: 47512 - protein, 174 aa, Homo sapiens; identical to SEQ ID NO: 47496
  Payload ID: 9617
  Gene Symbol: LY6G6D
  Gene Name: lymphocyte antigen 6 complex, locus G6D
  ENSP ID: ENSP00000414791

SEQ ID NO: 47513 - protein, 100 aa, Homo sapiens
  Payload ID: 9618
  Gene Symbol: LY6G6E
  Gene Name: lymphocyte antigen 6 complex, locus G6E (pseudogene)
  ENSP ID: ENSP00000372909
MGTSSIFLCVLFLCGALGLTMSPARGRLRCYICGFTKPCHPVPTECRDDEACGISIGTSGRTLVQWPFSRRLPTSIHPAFPVAPASACLFHPTDQSEITE

SEQ ID NO: 47514 - protein, 125 aa, Homo sapiens
  Payload ID: 9618
  Gene Symbol: LY6G6E
  Gene Name: lymphocyte antigen 6 complex, locus G6E (pseudogene)
  ENSP ID: ENSP00000372910
MGTSSIFLCVLFLCGALGLTMSPARGRLRCYICGFTKPCHPVPTECRDDEACGISIGTSGKSCLSRAQCPLPGYATYWLHSYTLWHHCCEQDLCNIAASPQQLTSLLASLPLFVASFAGRGHLLH

SEQ ID NO: 47515 - protein, 100 aa, Homo sapiens; identical to SEQ ID NO: 47513
  Payload ID: 9618
  Gene Symbol: LY6G6E
  Gene Name: lymphocyte antigen 6 complex, locus G6E (pseudogene)
  ENSP ID: ENSP00000382095

SEQ ID NO: 47516 - protein, 88 aa, Homo sapiens
  Payload ID: 9618
  Gene Symbol: LY6G6E
  Gene Name: lymphocyte antigen 6 complex, locus G6E (pseudogene)
  ENSP ID: ENSP00000386842
MLQLYKSRDLGVQITSPRFLSLCLAMGTSSIFLCVLFLCGALGLTMSPARGRLRCYICGFTKPCHPVPTECRDDEACGISIGTSDAHC

SEQ ID NO: 47517 - protein, 100 aa, Homo sapiens; identical to SEQ ID NO: 47513
  Payload ID: 9618
  Gene Symbol: LY6G6E
  Gene Name: lymphocyte antigen 6 complex, locus G6E (pseudogene)
  ENSP ID: ENSP00000388932

SEQ ID NO: 47518 - protein, 66 aa, Homo sapiens
  Payload ID: 9618
  Gene Symbol: LY6G6E
  Gene Name: lymphocyte antigen 6 complex, locus G6E (pseudogene)
  ENSP ID: ENSP00000393941
MGTSSIFLCVLFLCGALGLTMSPARGRLRCYICGFTKPCHPVPTECRDDEACGISIGTSDQSEITE

SEQ ID NO: 47519 - protein, 66 aa, Homo sapiens; identical to SEQ ID NO: 47518
  Payload ID: 9618
  Gene Symbol: LY6G6E
  Gene Name: lymphocyte antigen 6 complex, locus G6E (pseudogene)
  ENSP ID: ENSP00000398849

SEQ ID NO: 47520 - protein, 100 aa, Homo sapiens; identical to SEQ ID NO: 47513
  Payload ID: 9618
  Gene Symbol: LY6G6E
  Gene Name: lymphocyte antigen 6 complex, locus G6E (pseudogene)
  ENSP ID: ENSP00000403996

SEQ ID NO: 47521 - protein, 66 aa, Homo sapiens; identical to SEQ ID NO: 47518
  Payload ID: 9618
  Gene Symbol: LY6G6E
  Gene Name: lymphocyte antigen 6 complex, locus G6E (pseudogene)
  ENSP ID: ENSP00000407275

SEQ ID NO: 47522 - protein, 66 aa, Homo sapiens; identical to SEQ ID NO: 47518
  Payload ID: 9618
  Gene Symbol: LY6G6E
  Gene Name: lymphocyte antigen 6 complex, locus G6E (pseudogene)
  ENSP ID: ENSP00000410718

SEQ ID NO: 47523 - protein, 100 aa, Homo sapiens; identical to SEQ ID NO: 47513
  Payload ID: 9618
  Gene Symbol: LY6G6E
  Gene Name: lymphocyte antigen 6 complex, locus G6E (pseudogene)
  ENSP ID: ENSP00000411081

SEQ ID NO: 47524 - protein, 100 aa, Homo sapiens; identical to SEQ ID NO: 47513
  Payload ID: 9618
  Gene Symbol: LY6G6E
  Gene Name: lymphocyte antigen 6 complex, locus G6E (pseudogene)
  ENSP ID: ENSP00000413547

SEQ ID NO: 47525 - protein, 66 aa, Homo sapiens; identical to SEQ ID NO: 47518
  Payload ID: 9618
  Gene Symbol: LY6G6E
  Gene Name: lymphocyte antigen 6 complex, locus G6E (pseudogene)
  ENSP ID: ENSP00000414035

SEQ ID NO: 47526 - protein, 66 aa, Homo sapiens; identical to SEQ ID NO: 47518
  Payload ID: 9618
  Gene Symbol: LY6G6E
  Gene Name: lymphocyte antigen 6 complex, locus G6E (pseudogene)
  ENSP ID: ENSP00000414169

SEQ ID NO: 47527 - protein, 66 aa, Homo sapiens; identical to SEQ ID NO: 47518
  Payload ID: 9618
  Gene Symbol: LY6G6E
  Gene Name: lymphocyte antigen 6 complex, locus G6E (pseudogene)
  ENSP ID: ENSP00000416475

SEQ ID NO: 47528 - protein, 100 aa, Homo sapiens; identical to SEQ ID NO: 47513
  Payload ID: 9618
  Gene Symbol: LY6G6E
  Gene Name: lymphocyte antigen 6 complex, locus G6E (pseudogene)
  ENSP ID: ENSP00000416966

SEQ ID NO: 47529 - protein, 128 aa, Homo sapiens
  Payload ID: 9618
  Gene Symbol: LY6G6E
  Gene Name: lymphocyte antigen 6 complex, locus G6E (pseudogene)
  ENSP ID: ENSP00000435573
MGTSSIFLCVLFLCGALGLTMSPARGRLRCYICGFTKPCHPVPTECRDDEACGISIGTSVKKLPLKGPVPSARLCHLLAALLHSVAPLLRAGPVQHSRFPTAAHQPPRLPAPLCGQLRWERTPPPLAS

SEQ ID NO: 47530 - protein, 125 aa, Homo sapiens; identical to SEQ ID NO: 47514
  Payload ID: 9618
  Gene Symbol: LY6G6E
  Gene Name: lymphocyte antigen 6 complex, locus G6E (pseudogene)
  ENSP ID: ENSP00000447045

SEQ ID NO: 47531 - protein, 125 aa, Homo sapiens; identical to SEQ ID NO: 47514
  Payload ID: 9618
  Gene Symbol: LY6G6E
  Gene Name: lymphocyte antigen 6 complex, locus G6E (pseudogene)
  ENSP ID: ENSP00000447438

SEQ ID NO: 47532 - protein, 125 aa, Homo sapiens; identical to SEQ ID NO: 47514
  Payload ID: 9618
  Gene Symbol: LY6G6E
  Gene Name: lymphocyte antigen 6 complex, locus G6E (pseudogene)
  ENSP ID: ENSP00000447596

SEQ ID NO: 47533 - protein, 125 aa, Homo sapiens; identical to SEQ ID NO: 47514
  Payload ID: 9618
  Gene Symbol: LY6G6E
  Gene Name: lymphocyte antigen 6 complex, locus G6E (pseudogene)
  ENSP ID: ENSP00000448748

SEQ ID NO: 47534 - protein, 125 aa, Homo sapiens; identical to SEQ ID NO: 47514
  Payload ID: 9618
  Gene Symbol: LY6G6E
  Gene Name: lymphocyte antigen 6 complex, locus G6E (pseudogene)
  ENSP ID: ENSP00000448874

SEQ ID NO: 47535 - protein, 125 aa, Homo sapiens; identical to SEQ ID NO: 47514
  Payload ID: 9618
  Gene Symbol: LY6G6E
  Gene Name: lymphocyte antigen 6 complex, locus G6E (pseudogene)
  ENSP ID: ENSP00000449142

SEQ ID NO: 47536 - protein, 297 aa, Homo sapiens
  Payload ID: 9619
  Gene Symbol: LY6G6F
  Gene Name: lymphocyte antigen 6 complex, locus G6F
  Uniprot ID: Q5SQ64
  ENSP ID: ENSP00000364992
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRDASIPQFKPEIQVYENIHLARLGPPAHKPR

SEQ ID NO: 47537 - protein, 297 aa, Homo sapiens [sequence omitted]

SEQ ID NO: 47538 - protein, 297 aa, Homo sapiens; identical to SEQ ID NO: 47536
  Payload ID: 9619
  Gene Symbol: LY6G6F
  Gene Name: lymphocyte antigen 6 complex, locus G6F
  Uniprot ID: Q5SQ64
  ENSP ID: ENSP00000389102

SEQ ID NO: 47539 - protein, 297 aa, Homo sapiens [sequence omitted]

SEQ ID NO: 47540 - protein, 297 aa, Homo sapiens; identical to SEQ ID NO: 47536
  Payload ID: 9619
  Gene Symbol: LY6G6F
  Gene Name: lymphocyte antigen 6 complex, locus G6F
  Uniprot ID: Q5SQ64
  ENSP ID: ENSP00000404884

SEQ ID NO: 47541 - protein, 297 aa, Homo sapiens; identical to SEQ ID NO: 47536
  Payload ID: 9619
  Gene Symbol: LY6G6F
  Gene Name: lymphocyte antigen 6 complex, locus G6F
  Uniprot ID: Q5SQ64
  ENSP ID: ENSP00000407535

SEQ ID NO: 47542 - protein, 297 aa, Homo sapiens; identical to SEQ ID NO: 47536
  Payload ID: 9619
  Gene Symbol: LY6G6F
  Gene Name: lymphocyte antigen 6 complex, locus G6F
  Uniprot ID: Q5SQ64
  ENSP ID: ENSP00000409959

SEQ ID NO: 47543 - protein, 161 aa, Homo sapiens
  Payload ID: 9620
  Gene Symbol: LY6H
  Gene Name: lymphocyte antigen 6 complex, locus H
  Uniprot ID: O94772
  ENSP ID: ENSP00000342711
MLAPQRTRAPSPRAAPRPTRSMLPAAMKGLGLALLAVLLCSAPAHGLWCQDCTLTTNSSHCTPKQCQPSDTVCASVRITDPSSSRKDHSVNKMCASSCDFVKRHFFSDYLMGFINSGILKVDVDCCEKDLCNGAAGAGHSPWALAGGLLLSLGPALLWAGP

SEQ ID NO: 47544 - protein, 161 aa, Homo sapiens; identical to SEQ ID NO: 47543
  Payload ID: 9620
  Gene Symbol: LY6H
  Gene Name: lymphocyte antigen 6 complex, locus H
  Uniprot ID: O94772
  ENSP ID: ENSP00000399485

SEQ ID NO: 47545 - protein, 140 aa, Homo sapiens
  Payload ID: 9620
  Gene Symbol: LY6H
  Gene Name: lymphocyte antigen 6 complex, locus H
  Uniprot ID: O94772
  ENSP ID: ENSP00000409899
MLPAAMKGLGLALLAVLLCSAPAHGLWCQDCTLTTNSSHCTPKQCQPSDTVCASVRITDPSSSRKDHSVNKMCASSCDFVKRHFFSDYLMGFINSGILKVDVDCCEKDLCNGAAGAGHSPWALAGGLLLSLGPALLWAGP

SEQ ID NO: 47546 - protein, 140 aa, Homo sapiens; identical to SEQ ID NO: 47545
  Payload ID: 9620
  Gene Symbol: LY6H
  Gene Name: lymphocyte antigen 6 complex, locus H
  Uniprot ID: O94772
  ENSP ID: ENSP00000478470

SEQ ID NO: 47547 - protein, 140 aa, Homo sapiens; identical to SEQ ID NO: 47545
  Payload ID: 9620
  Gene Symbol: LY6H
  Gene Name: lymphocyte antigen 6 complex, locus H
  Uniprot ID: O94772
  ENSP ID: ENSP00000480084

SEQ ID NO: 47548 - protein, 161 aa, Homo sapiens; identical to SEQ ID NO: 47543
  Payload ID: 9620
  Gene Symbol: LY6H
  Gene Name: lymphocyte antigen 6 complex, locus H
  Uniprot ID: O94772
  ENSP ID: ENSP00000482094

SEQ ID NO: 47549 - protein, 161 aa, Homo sapiens; identical to SEQ ID NO: 47543
  Payload ID: 9620
  Gene Symbol: LY6H
  Gene Name: lymphocyte antigen 6 complex, locus H
  Uniprot ID: O94772
  ENSP ID: ENSP00000487965

SEQ ID NO: 47550 - protein, 165 aa, Homo sapiens
  Payload ID: 9621
  Gene Symbol: LY6K
  Gene Name: lymphocyte antigen 6 complex, locus K
  Uniprot ID: Q17RY6
  ENSP ID: ENSP00000292430
MALLALLLVVALPRVWTDANLTARQRDPEDSQRTDEGDNRVWCHVCERENTFECQNPRRCKWTEPYCVIAAVKIFPRFFMVAKQCSAGCAAMERPKPEEKRFLLEEPMPFFYLKCCKIRYCNLEGPPINSSVFKEYAGSMGESCGGLWLAILLLLASIAAGLSLS

SEQ ID NO: 47551 - protein, 100 aa, Homo sapiens
  Payload ID: 9621
  Gene Symbol: LY6K
  Gene Name: lymphocyte antigen 6 complex, locus K
  ENSP ID: ENSP00000427749
MALLALLLVVALPRVWTDANLTARQRDPEDSQRTDEGDNRVWCHVCERENTFECQNPRRCKWTEPYCVIAAVRRSSGLVNSDSAQQSLSSPSVSTKLVGC

SEQ ID NO: 47552 - protein, 85 aa, Homo sapiens
  Payload ID: 9621
  Gene Symbol: LY6K
  Gene Name: lymphocyte antigen 6 complex, locus K
  ENSP ID: ENSP00000428432
MALLALLLVVALPRVWTDANLTARQRDPEDSQRTDEGDNRVWCHVCERENTFECQNPRRCKWTEPYCVIAAVSEYLRSCWGPKGR

SEQ ID NO: 47553 - protein, 105 aa, Homo sapiens
  Payload ID: 9621
  Gene Symbol: LY6K
  Gene Name: lymphocyte antigen 6 complex, locus K
  Uniprot ID: Q17RY6
  ENSP ID: ENSP00000429695
MALLALLLVVALPRVWTDANLTARQRDPEDSQRTDEGDNRVWCHVCERENTFECQNPRRCKWTEPYCVIAAVTVLRWLCSDGETQARGEAVSPGRAHALLLPQVL

SEQ ID NO: 47554 - protein, 1722 aa, Homo sapiens
  Payload ID: 9622
  Gene Symbol: LY75
  Gene Name: lymphocyte antigen 75
  Uniprot ID: O60449
  ENSP ID: ENSP00000263636
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLGPDYTAIAIIVATLSILVLMGGLIWFLFQRHRLHLAGFSSVRYAQGVNEDEIMLPSFHD

SEQ ID NO: 47555 - protein, 162 aa, Homo sapiens
  Payload ID: 9623
  Gene Symbol: LY86
  Gene Name: lymphocyte antigen 86
  Uniprot ID: O95711
  ENSP ID: ENSP00000230568
MKGFTATLFLWTLIFPSCSGGGGGKAWPTHVVCSDSGLEVLYQSCDPLQDFGFSVEKCSKQLKSNINIRFGIILREDIKELFLDLALMSQGSSVLNFSYPICEAALPKFSFCGRRKGEQIYYAGPVNNPEFTIPQGEYQVLLELYTEKRSTVACANATIMCS

SEQ ID NO: 47556 - protein, 162 aa, Homo sapiens; identical to SEQ ID NO: 47555
  Payload ID: 9623
  Gene Symbol: LY86
  Gene Name: lymphocyte antigen 86
  Uniprot ID: O95711
  ENSP ID: ENSP00000369286

SEQ ID NO: 47557 - protein, 655 aa, Homo sapiens
  Payload ID: 9624
  Gene Symbol: LY9
  Gene Name: lymphocyte antigen 9
  Uniprot ID: Q9HBG7
  ENSP ID: ENSP00000263285
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVPPPQQNDLEIPESPTYENFT

SEQ ID NO: 47558 - protein, 341 aa, Homo sapiens
  Payload ID: 9624
  Gene Symbol: LY9
  Gene Name: lymphocyte antigen 9
  ENSP ID: ENSP00000357014
  MOD_RES (1)..(1): Any amino acid
XKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQVVPPPQQNDLEIPESPTYENFT

SEQ ID NO: 47559 - protein, 641 aa, Homo sapiens
  Payload ID: 9624
  Gene Symbol: LY9
  Gene Name: lymphocyte antigen 9
  Uniprot ID: Q9HBG7
  ENSP ID: ENSP00000357016
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVPPPQQNDLEIPESPTYENFT

SEQ ID NO: 47560 - protein, 193 aa, Homo sapiens
  Payload ID: 9624
  Gene Symbol: LY9
  Gene Name: lymphocyte antigen 9
  ENSP ID: ENSP00000357018
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYAPFIEKLSVHVIEGDHRTLLEGSGLESIISTLAEPRVSVREG

SEQ ID NO: 47561 - protein, 565 aa, Homo sapiens
  Payload ID: 9624
  Gene Symbol: LY9
  Gene Name: lymphocyte antigen 9
  ENSP ID: ENSP00000376039
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVPPPQQNDLEIPESPTYENFT

SEQ ID NO: 47562 - protein, 71 aa, Homo sapiens
  Payload ID: 9624
  Gene Symbol: LY9
  Gene Name: lymphocyte antigen 9
  ENSP ID: ENSP00000473643
KSHTDDWAPGPFSSKPQRSQLQIFSSVLQTSLLFLLMEFLVESGSQTHLFWSRISKVLSRASEALESGNPS

SEQ ID NO: 47563 - protein, 61 aa, Homo sapiens
  Payload ID: 9624
  Gene Symbol: LY9
  Gene Name: lymphocyte antigen 9
  ENSP ID: ENSP00000476321
MVAPKSHTDDWAPGPFSSKPQRSQLQIFSSVLQTSLLFLLMGPTPGKHLSAAWPGTPLSSR

SEQ ID NO: 47564 - protein, 160 aa, Homo sapiens [sequence omitted]

SEQ ID NO: 47565 - protein, 130 aa, Homo sapiens
  Payload ID: 9625
  Gene Symbol: LY96
  Gene Name: lymphocyte antigen 96
  Uniprot ID: Q9Y6Y9
  ENSP ID: ENSP00000430533
MLPFLFFSTLFSSIFTEAQKQYWVCNSSDASISYTYCGRDLKQLYFNLYITVNTMNLPKRKEVICRGSDDDYSFCRALKGETVNTTISFSFKGIKFSKGKYKCVVEAISGSPEEMLFCLEFVILHQPNSN

SEQ ID NO: 47566 - protein, 627 aa, Homo sapiens
  Payload ID: 9626
  Gene Symbol: LCP1
  Gene Name: lymphocyte cytosolic protein 1 (L-plastin)
  Uniprot ID: P13796
  ENSP ID: ENSP00000315757
MARGSVSDEEMMELREAFAKVDTDGNGYISFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCKMINLSVPDTIDERTINKKKLTPFTIQENLNLALNSASAIGCHVVNIGAEDLKEGKPYLVLGLLWQVIKIGLFADIELSRNEALIALLREGESLEDLMKLSPEELLLRWANYHLENAGCNKIGNFSTDIKDSKAYYHLLEQVAPKGDEEGVPAVVIDMSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILEEIGGGQKVNDDIIVNWVNETLREAKKSSSISSFKDPKISTSLPVLDLIDAIQPGSINYDLLKTENLNDDEKLNNAKYAISMARKIGARVYALPEDLVEVNPKMVMTVFACLMGKGMKRV

SEQ ID NO: 47567 - protein, 627 aa, Homo sapiens; identical to SEQ ID NO: 47566
  Payload ID: 9626
  Gene Symbol: LCP1
  Gene Name: lymphocyte cytosolic protein 1 (L-plastin)
  Uniprot ID: P13796
  ENSP ID: ENSP00000381581

SEQ ID NO: 47568 - protein, 66 aa, Homo sapiens
  Payload ID: 9626
  Gene Symbol: LCP1
  Gene Name: lymphocyte cytosolic protein 1 (L-plastin)
  ENSP ID: ENSP00000402157
MARGSVSDEEMMELREAFAKVDTDGNGYISFNELNDLFKAACLPLPGYRVREITENLMATGDLDQD

SEQ ID NO: 47569 - protein, 246 aa, Homo sapiens
  Payload ID: 9626
  Gene Symbol: LCP1
  Gene Name: lymphocyte cytosolic protein 1 (L-plastin)
  ENSP ID: ENSP00000408052
MARGSVSDEEMMELREAFAKVDTDGNGYISFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCKMINLSVPDTIDERTINKKKLTPFTIQENLNLALNSASAIGCHVVNIGAEDLKEGKPYLVLGLLWQVIKIGLFADIELSRNE

SEQ ID NO: 47570 - protein, 533 aa, Homo sapiens
  Payload ID: 9627
  Gene Symbol: LCP2
  Gene Name: lymphocyte cytosolic protein 2 (SH2 domain containing leukocyte protein of 76kDa)
  Uniprot ID: Q13094
  ENSP ID: ENSP00000046794
MALRNVPFRSEVLGWDPDSLADYFKKLNYKDCEKAVKKYHIDGARFLNLTENDIQKFPKLRVPILSKLSQEINKNEERRSIFTRKPQVPRFPEETESHEEDNGGWSSFEEDDYESPNDDQDGEDDGDYESPNEEEEAPVEDDADYEPPPSNDEEALQNSILPAKPFPNSNSMYIDRPPSGKTPQQPPVPPQRPMAALPPPPAGRNHSPLPPPQTNHEEPSRSRNHKTAKLPAPSIDRSTKPPLDRSLAPFDREPFTLGKKPPFSDKPSIPAGRSLGEHLPKIQKPPLPPTTERHERSSPLPGKKPPVPKHGWGPDRRENDEDDVHQRPLPQPALLPMSSNTFPSRSTKPSPMNPLPSSHMPGAFSESNSSFPQSASLPPYFSQGPSNRPPIRAEGRNFPLPLPNKPRPPSPAEEENSLNEEWYVSYITRPEAEAALRKINQDGTFLVRDSSKKTTTNPYVLMVLYKDKVYNIQIRYQKESQVYLLGTGLRGKEDFLSVSDIIDYFRKMPLLLIDGKNRGSRYQCTLTHAAGYP

SEQ ID NO: 47571 - protein, 328 aa, Homo sapiens
  Payload ID: 9627
  Gene Symbol: LCP2
  Gene Name: lymphocyte cytosolic protein 2 (SH2 domain containing leukocyte protein of 76kDa)
  ENSP ID: ENSP00000428871
MQPLPPPQTNHEEPSRSRNHKTAKLPAPSIDRSTKPPLDRSLAPFDREPFTLGKKPPFSDKPSIPAGRSLGEHLPKIQKPPLPPTTERHERSSPLPGKKPPVPKHGWGPDRRENDEDDVHQRPLPQPALLPMSSNTFPSRSTKPSPMNPLPSSHMPGAFSESNSSFPQSASLPPYFSQGPSNRPPIRAEGRNFPLPLPNKPRPPSPAEEENSLNEEWYVSYITRPEAEAALRKINQDGTFLVRDSSKKTTTNPYVLMVLYKDKVYNIQIRYQKESQVYLLGTGLRGKEDFLSVSDIIDYFRKMPLLLIDGKNRGSRYQCTLTHAAGYP

SEQ ID NO: 47572 - protein, 140 aa, Homo sapiens
  Payload ID: 9627
  Gene Symbol: LCP2
  Gene Name: lymphocyte cytosolic protein 2 (SH2 domain containing leukocyte protein of 76kDa)
  ENSP ID: ENSP00000430391
MQPLPPPQTNHEEPSRSRNHKTAKRKKPPFSDKPSIPAGRSLGEHLPKIQKPPLPPTTERHERSSPLPGKKPPVPKHGWGPDRRENDEDDVHQRPLPQPALLPMSSNTFPSRSTKPSPMNPLPSSHMPGAFSESNSSFPQ

SEQ ID NO: 47573 - protein, 533 aa, Homo sapiens [sequence omitted]

SEQ ID NO: 47574 - protein, 414 aa, Homo sapiens
  Payload ID: 9628
  Gene Symbol: LEXM
  Gene Name: lymphocyte expansion molecule
  Uniprot ID: Q3ZCV2
  ENSP ID: ENSP00000350924
MRESQDAAGAHGWNRVGSTATKWFTGAPFGVQSHRFDISAVYPNWKKFSTFTEAPYSTRYSTQVSHIGPGTYSSKETCFSKKKLMKEVDTGWAKAQEATRLTQLPHFQYQAIMKEKRLKEQKLGPGSYNLKDFLEQLREKPCSTRGLLSSGEVRFRGLTGNYYPGPGNYGEKGNPYTKLEENAWNRSHSEGLMCRMSNKPHPRPHQGSGLGPGTYFFKSDLETYVARSVGTRGPYDTFSGDRSKPLPYGHYSMQKKKPRELMNFKSFVEELNSHHNKKHGVFSKLPRNPKTPTERIYWANLSQCPRTLATSGPSFWLPQEKKCKPVNQPPFLLTSKGSGAKACQMIMGSWNPVGVGRYLNTWLMETKDRRQRYRSLFLSGSKRYLSDLARDMLMQIRLFCWKGLEVINFGLSPM

SEQ ID NO: 47575 - protein, 418 aa, Homo sapiens
  Payload ID: 9628
  Gene Symbol: LEXM
  Gene Name: lymphocyte expansion molecule
  Uniprot ID: Q3ZCV2
  ENSP ID: ENSP00000360320
MRESQDAAGAHGWNRVGSTATKWFTGAPFGVQSHRFDISAVYPNWKKFSTFTEAPYSTRYSTQVSHIGPGTYSSKETCFSKKKLMKEVDTGWAKAQEATRLTQLPHFQYQAIMKEKRLKEQKLGPGSYNLKDFLEQLREKPCSTRGLLSSGEVRFRGLTGNYYPGPGNYGEKGNPYTKLEENAWNRSHSEGLMCRMSNKPHPRPHQGSGLGPGTYFFKSDLETYVARSVGTRGPYDTFSGDRSKPLPYGHYSMQKKKPRELMNFKSFVEELNSHHNKKHGVFSKLPRNPKTPTERIYWANLSQCPRTLATSGPSFWLPQEKKCKPVNQPPFLLTSKGSGAKACQMIMGSWNPVGVGRYLNTWLMETKDRRQRYRSLFLSGSKRYLSDLARDMLMQERITPFTKGKCPPTVDYNSDPTP

SEQ ID NO: 47576 - protein, 382 aa, Homo sapiens
  Payload ID: 9629
  Gene Symbol: LAX1
  Gene Name: lymphocyte transmembrane adaptor 1
  Uniprot ID: Q8IWV1
  ENSP ID: ENSP00000356186
MRSHFLQWALATSRNKDQITNIFSGFAGLLAILLVVAVFCILWNWNKRKKRQVPYLRVTVMPLLTLPQTRQRAKNIYDILPWRQEDLGRHESRSMRIFSTESLLSRNSESPEHVPSQAGNAFQEHTAHIHATEYAVGIYDNAMVPQMCGNLTPSAHCINVRASRDCASISSEDSHDYVNVPTAEEIAETLASTKSPSRNLFVLPSTQKLEFTEERDEGCGDAGDCTSLYSPGAEDSDSLSNGEGSSQISNDYVNMTGLDLSAIQERQLWVAFQCCRDYENVPAADPSGSQQQAEKDVPSSNIGHVEDKTDDPGTHVQCVKRTFLASGDYADFQPFTQSEDSQMKHREEMSNEDSSDYENVLTAKLGGRDSEQGPGTQLLPDE

SEQ ID NO: 47577 - protein, 398 aa, Homo sapiens
  Payload ID: 9629
  Gene Symbol: LAX1
  Gene Name: lymphocyte transmembrane adaptor 1
  Uniprot ID: Q8IWV1
  ENSP ID: ENSP00000406970
MDGVTPTLSTIRGRTLESSTLHVTPRSLDRNKDQITNIFSGFAGLLAILLVVAVFCILWNWNKRKKRQVPYLRVTVMPLLTLPQTRQRAKNIYDILPWRQEDLGRHESRSMRIFSTESLLSRNSESPEHVPSQAGNAFQEHTAHIHATEYAVGIYDNAMVPQMCGNLTPSAHCINVRASRDCASISSEDSHDYVNVPTAEEIAETLASTKSPSRNLFVLPSTQKLEFTEERDEGCGDAGDCTSLYSPGAEDSDSLSNGEGSSQISNDYVNMTGLDLSAIQERQLWVAFQCCRDYENVPAADPSGSQQQAEKDVPSSNIGHVEDKTDDPGTHVQCVKRTFLASGDYADFQPFTQSEDSQMKHREEMSNEDSSDYENVLTAKLGGRDSEQGPGTQLLPDE

SEQ ID NO: 47578 - protein, 525 aa, Homo sapiens
  Payload ID: 9630
  Gene Symbol: LAG3
  Gene Name: lymphocyte-activation gene 3
  Uniprot ID: P18627
  ENSP ID: ENSP00000203629
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 47579 - protein, 360 aa, Homo sapiens
  Payload ID: 9630
  Gene Symbol: LAG3
  Gene Name: lymphocyte-activation gene 3
  Uniprot ID: P18627
  ENSP ID: ENSP00000413825
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITGQPQVGKE

SEQ ID NO: 47580 - protein, 339 aa, Homo sapiens
  Payload ID: 9631
  Gene Symbol: LSP1
  Gene Name: lymphocyte-specific protein 1
  Uniprot ID: P33241
  ENSP ID: ENSP00000308383
MAEASSDPGAEEREELLGPTAQWSVEDEEEAVHEQCQHERDRQLQAQDEEGGGHVPERPKQEMLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFVATGHGKYEKVLVEGGPAP

SEQ ID NO: 47581 - protein, 467 aa, Homo sapiens
  Payload ID: 9631
  Gene Symbol: LSP1
  Gene Name: lymphocyte-specific protein 1
  Uniprot ID: P33241
  ENSP ID: ENSP00000371194
MAPIWSPPGRVSGCHLSSGPAPGSAVGPWLGTPHPSLPLPLAPHKPPPPGLPGSAGQTSLPAQRECVFPGDAAVHQELCGLGFEECLGSIPQAHQCYLTNGPKRRKCSPRRRGRAPAWLCGGSPPCHQGLGHEHPSSGPSTNCSPRPTAQWSVEDEEEAVHEQCQHERDRQLQAQDEEGGGHVPERPKQEMLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFVATGHGKYEKVLVEGGPAP

SEQ ID NO: 47582 - protein, 277 aa, Homo sapiens
  Payload ID: 9631
  Gene Symbol: LSP1
  Gene Name: lymphocyte-specific protein 1
  Uniprot ID: P33241
  ENSP ID: ENSP00000383932
MLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFVATGHGKYEKVLVEGGPAP

SEQ ID NO: 47583 - protein, 277 aa, Homo sapiens; identical to SEQ ID NO: 47582
  Payload ID: 9631
  Gene Symbol: LSP1
  Gene Name: lymphocyte-specific protein 1
  Uniprot ID: P33241
  ENSP ID: ENSP00000384022

SEQ ID NO: 47584 - protein, 275 aa, Homo sapiens
  Payload ID: 9631
  Gene Symbol: LSP1
  Gene Name: lymphocyte-specific protein 1
  ENSP ID: ENSP00000400346
MLEERSEARPTAQWSVEDEEEAVHEQCQHERDRQLQAQDEEGGGHVPERPKQEMLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCK

SEQ ID NO: 47585 - protein, 175 aa, Homo sapiens
  Payload ID: 9631
  Gene Symbol: LSP1
  Gene Name: lymphocyte-specific protein 1
  ENSP ID: ENSP00000400999
MPTAQWSVEDEEEAVHEQCQHERDRQLQAQDEEGGGHVPERPKQEMLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPL

SEQ ID NO: 47586 - protein, 126 aa, Homo sapiens
  Payload ID: 9631
  Gene Symbol: LSP1
  Gene Name: lymphocyte-specific protein 1
  ENSP ID: ENSP00000402543
MLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQS

SEQ ID NO: 47587 - protein, 122 aa, Homo sapiens
  Payload ID: 9631
  Gene Symbol: LSP1
  Gene Name: lymphocyte-specific protein 1
  ENSP ID: ENSP00000403460
MKASGRGRWPGRAPQSSTGRHGVGVSGRGPGCWVLRPTAQWSVEDEEEAVHEQCQHERDRQLQAQDEEGGGHVPERPKQEMLLSLKPSEAPELDEDEGFGDWSQRPEQRQQHEGAQGALDSG

SEQ ID NO: 47588 - protein, 60 aa, Homo sapiens
  Payload ID: 9631
  Gene Symbol: LSP1
  Gene Name: lymphocyte-specific protein 1
  ENSP ID: ENSP00000411191
MLLSLKPSEAPELDEDEGFGDWSQRPEQRQQHEGAQGALDSGEPPQCRSPEGEQEDRPGL

SEQ ID NO: 47589 - protein, 222 aa, Homo sapiens
  Payload ID: 9631
  Gene Symbol: LSP1
  Gene Name: lymphocyte-specific protein 1
  ENSP ID: ENSP00000412405
MLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCK

SEQ ID NO: 47590 - protein, 64 aa, Homo sapiens
  Payload ID: 9631
  Gene Symbol: LSP1
  Gene Name: lymphocyte-specific protein 1
  ENSP ID: ENSP00000414106
MLLSLKPSEAPELDEDEGFGDWSQRPEQRQQHEGAQGALDSGEPPQCRSPEGEQEDRPGLHAYE

SEQ ID NO: 47591 - protein, 222 aa, Homo sapiens; identical to SEQ ID NO: 47589
  Payload ID: 9631
  Gene Symbol: LSP1
  Gene Name: lymphocyte-specific protein 1
  ENSP ID: ENSP00000416363

SEQ ID NO: 47592 - protein, 277 aa, Homo sapiens; identical to SEQ ID NO: 47582
  Payload ID: 9631
  Gene Symbol: LSP1
  Gene Name: lymphocyte-specific protein 1
  Uniprot ID: P33241
  ENSP ID: ENSP00000484140

SEQ ID NO: 47593 - protein, 399 aa, Homo sapiens
  Payload ID: 9632
  Gene Symbol: LEF1
  Gene Name: lymphoid enhancer-binding factor 1
  Uniprot ID: Q9UJU2
  ENSP ID: ENSP00000265165
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 47594 - protein, 386 aa, Homo sapiens
  Payload ID: 9632
  Gene Symbol: LEF1
  Gene Name: lymphoid enhancer-binding factor 1
  Uniprot ID: Q9UJU2
  ENSP ID: ENSP00000369284
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGGKRSSFPTCKAKAATPGPLLEMEAC

SEQ ID NO: 47595 - protein, 371 aa, Homo sapiens
  Payload ID: 9632
  Gene Symbol: LEF1
  Gene Name: lymphoid enhancer-binding factor 1
  Uniprot ID: Q9UJU2
  ENSP ID: ENSP00000406176
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 47596 - protein, 329 aa, Homo sapiens
  Payload ID: 9632
  Gene Symbol: LEF1
  Gene Name: lymphoid enhancer-binding factor 1
  Uniprot ID: Q9UJU2
  ENSP ID: ENSP00000422334
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVCSAFLLPHPFLIPSTPSPNHHHHHLLGSLSMNRERSRSQKDLTLRSL

SEQ ID NO: 47597 - protein, 173 aa, Homo sapiens
  Payload ID: 9632
  Gene Symbol: LEF1
  Gene Name: lymphoid enhancer-binding factor 1
  ENSP ID: ENSP00000422801
MAEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSR

SEQ ID NO: 47598 - protein, 303 aa, Homo sapiens
  Payload ID: 9632
  Gene Symbol: LEF1
  Gene Name: lymphoid enhancer-binding factor 1
  Uniprot ID: Q9UJU2
  ENSP ID: ENSP00000422840
MAEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 47599 - protein, 145 aa, Homo sapiens
  Payload ID: 9632
  Gene Symbol: LEF1
  Gene Name: lymphoid enhancer-binding factor 1
  ENSP ID: ENSP00000427365
MAEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGW

SEQ ID NO: 47600 - protein, 133 aa, Homo sapiens
  Payload ID: 9632
  Gene Symbol: LEF1
  Gene Name: lymphoid enhancer-binding factor 1
  ENSP ID: ENSP00000427459
MAEVARQAQTSQEPYHDKAREHPDDGKHPDGGLYNKGPSYSSYSGYIMMPNMNNDPYMSNGSLSPPIPRTACPDILQLLISLLFIPCLRVVLDRSPHLLAGKVSLYIPSRVDSGNPTHPHCQSTLPCPGFPII

SEQ ID NO: 47601 - protein, 499 aa, Homo sapiens
  Payload ID: 9633
  Gene Symbol: LRMP
  Gene Name: lymphoid-restricted membrane protein
  Uniprot ID: Q12912
  ENSP ID: ENSP00000346442
MNDDPSMEENGVERVCPESLLQSREYSSLPLPRHTSSTDGTITSSDPGLEILNMASCDLDRNSLCKKEEDTRSASPTIEAQGTSPAHDNIAFQDSTSKDKTILNLEAKEEPETIEEHKKEHASGDSVVSPLPVTTVKSVNLRQSENTSANEKEVEAEFLRLSLGFKCDWFTLEKRVKLEERSRDLAEENLKKEITNCLKLLESLTPLCEDDNQAQEIIKKLEKSIKFLSQCAARVASRAEMLGAINQESRVSKAVEVMIQHVENLKRMYAKEHAELEELKQVLLQNERSFNPLEDDDDCQIKKRSASLNSKPSSLRRVTIASLPRNIGNAGMVAGMENNDRFSRRSSSWRILGSKQSEHRPSLPRFISTYSWADAEEEKCELKTKDDSEPSGEETVERTRKPSLSEKKNNPSKWDVSSVYDTIASWATNLKSSIRKANKALWLSIAFIVLFAALMSFLTGQLFQKSVDAAPTQQEDSWTSLEHILWPFTRLRHNGPPPV

SEQ ID NO: 47602 - protein, 348 aa, Homo sapiens
  Payload ID: 9633
  Gene Symbol: LRMP
  Gene Name: lymphoid-restricted membrane protein
  ENSP ID: ENSP00000354805
MNDDPSMEENGVERVCPESLLQSREYSSLPLPRHTSSTDGTITSSDPGLEILNMASCDLDRNSLCKKEEDTRSASPTIEAQGTSPAHDNIAFQDSTSKDKTILNLEAKEEPETIEEHKKEHASGDSVVSPLPVTTVKSVNLRQSENTSANEKEVEAEFLRLSLGFKCDWFTLEKRVKLEERSRDLAEENLKKEITNCLKLLESLTPLCEDDNQAQEIIKKLEKSIKFLSQCAARVASRAEMLGAINQESRVSKAVEVMIQHVENLKRMYAKEHAELEELKQVLLQNERSFNPLEDDDDCQIKKRSASLNSKPSSLRRVTIASLPRNIGNAGMVAGMENNDRFSRRSSS

SEQ ID NO: 47603 - protein, 446 aa, Homo sapiens
  Payload ID: 9633
  Gene Symbol: LRMP
  Gene Name: lymphoid-restricted membrane protein
  ENSP ID: ENSP00000444056
MASCDLDRNSLCKKEEDTRSASPTIEAQGTSPAHDNIAFQDSTSKDKTILNLEAKEEPETIEEHKKEHASGDSVVSPLPVTTVKSVNLRQSENTSANEKEVEAEFLRLSLGFKCDWFTLEKRVKLEERSRDLAEENLKKEITNCLKLLESLTPLCEDDNQAQEIIKKLEKSIKFLSQCAARVASRAEMLGAINQESRVSKAVEVMIQHVENLKRMYAKEHAELEELKQVLLQNERSFNPLEDDDDCQIKKRSASLNSKPSSLRRVTIASLPRNIGNAGMVAGMENNDRFSRRSSSWRILGSKQSEHRPSLPRFISTYSWADAEEEKCELKTKDDSEPSGEETVERTRKPSLSEKKNNPSKWDVSSVYDTIASWATNLKSSIRKANKALWLSIAFIVLFAALMSFLTGQLFQKSVDAAPTQQEDSWTSLEHILWPFTRLRHNGPPPV

SEQ ID NO: 47604 - protein, 499 aa, Homo sapiens; identical to SEQ ID NO: 47601
  Payload ID: 9633
  Gene Symbol: LRMP
  Gene Name: lymphoid-restricted membrane protein
  Uniprot ID: Q12912
  ENSP ID: ENSP00000446496

SEQ ID NO: 47605 - protein, 118 aa, Homo sapiens
  Payload ID: 9633
  Gene Symbol: LRMP
  Gene Name: lymphoid-restricted membrane protein
  ENSP ID: ENSP00000448534
MNDDPSMEENGVERVCPESLLQSREYSSLPLPRHTSSTDGTITSSDPGLEILNMASCDLDRNSLCKKEEDTRSASPTIEAQGTSPAHDNIAFQDSTSKDKTILNLEAKEEPETIEEHK

SEQ ID NO: 47606 - protein, 499 aa, Homo sapiens; identical to SEQ ID NO: 47601
  Payload ID: 9633
  Gene Symbol: LRMP
  Gene Name: lymphoid-restricted membrane protein
  Uniprot ID: Q12912
  ENSP ID: ENSP00000450246

SEQ ID NO: 47607 - protein, 76 aa, Homo sapiens
  Payload ID: 9633
  Gene Symbol: LRMP
  Gene Name: lymphoid-restricted membrane protein
  ENSP ID: ENSP00000450634
MNDDPSMEENGVERVCPESLLQSREYSSLPLPRHTSSTDGTITSSDPGLEILNMASCDLDRNSLCKKEEDTRSASP

SEQ ID NO: 47608 - protein, 69 aa, Homo sapiens
  Payload ID: 9633
  Gene Symbol: LRMP
  Gene Name: lymphoid-restricted membrane protein
  ENSP ID: ENSP00000450767
  MOD_RES (1)..(1): Any amino acid
XEKEVEAEFLRLSLGFKCDWFTLEKRVKLEERSRDLAEENLKKEITNCLKLLEAEKESYRKLSNRKYQF

SEQ ID NO: 47609 - protein, 8 aa, Homo sapiens
  Payload ID: 9633
  Gene Symbol: LRMP
  Gene Name: lymphoid-restricted membrane protein
  ENSP ID: ENSP00000451048
MNDDPSME

SEQ ID NO: 47610 - protein, 62 aa, Homo sapiens
  Payload ID: 9633
  Gene Symbol: LRMP
  Gene Name: lymphoid-restricted membrane protein
  ENSP ID: ENSP00000451159
MNDDPSMEENGVERVCPESLLQSREYSSLPLPRHTSSTDGTITSSETRSVRKRRIQDQLLPR

SEQ ID NO: 47611 - protein, 97 aa, Homo sapiens
  Payload ID: 9633
  Gene Symbol: LRMP
  Gene Name: lymphoid-restricted membrane protein
  ENSP ID: ENSP00000451196
  MOD_RES (1)..(1): Any amino acid
XDNQAQEIIKKLEKSIKFLSQCAARVASRAEMLGAINQESRVSKAVEVMIQHVENLKRMYAKEHAELEELKQVLLQNERSFNPLEDDADTHVVPTLC

SEQ ID NO: 47612 - protein, 120 aa, Homo sapiens
  Payload ID: 9633
  Gene Symbol: LRMP
  Gene Name: lymphoid-restricted membrane protein
  ENSP ID: ENSP00000452116
MNDDPSMEENGVERVCPESLLQSREYSSLPLPRHTSSTDGTITSSDPGLEILNMASCDLDRNSLCKKEEDTRSASPTIEAQGTSPAHDNIAFQDSTSKDKTILNLEAKEEPETIEEHKKE

SEQ ID NO: 47613 - protein, 205 aa, Homo sapiens
  Payload ID: 9634
  Gene Symbol: LTA
  Gene Name: lymphotoxin alpha
  ENSP ID: ENSP00000372791
MTPPERLFLPRVCGTTLHLLLLGLLLVLLPGAQGLPGVGLTPSAAQTARQHPKMHLAHSNLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 47614 - protein, 205 aa, Homo sapiens; identical to SEQ ID NO: 47613
  Payload ID: 9634
  Gene Symbol: LTA
  Gene Name: lymphotoxin alpha
  ENSP ID: ENSP00000372793

SEQ ID NO: 47615 - protein, 205 aa, Homo sapiens
  Payload ID: 9634
  Gene Symbol: LTA
  Gene Name: lymphotoxin alpha
  ENSP ID: ENSP00000372991
MTPPERLFLPRVRGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 47616 - protein, 205 aa, Homo sapiens; identical to SEQ ID NO: 47615
  Payload ID: 9634
  Gene Symbol: LTA
  Gene Name: lymphotoxin alpha
  ENSP ID: ENSP00000383131

SEQ ID NO: 47617 - protein, 205 aa, Homo sapiens; identical to SEQ ID NO: 47615
  Payload ID: 9634
  Gene Symbol: LTA
  Gene Name: lymphotoxin alpha
  ENSP ID: ENSP00000387924

SEQ ID NO: 47618 - protein, 205 aa, Homo sapiens; identical to SEQ ID NO: 47615
  Payload ID: 9634
  Gene Symbol: LTA
  Gene Name: lymphotoxin alpha
  ENSP ID: ENSP00000395895

SEQ ID NO: 47619 - protein, 205 aa, Homo sapiens
  Payload ID: 9634
  Gene Symbol: LTA
  Gene Name: lymphotoxin alpha
  Uniprot ID: P01374
  ENSP ID: ENSP00000395976
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 47620 - protein, 205 aa, Homo sapiens; identical to SEQ ID NO: 47619
  Payload ID: 9634
  Gene Symbol: LTA
  Gene Name: lymphotoxin alpha
  Uniprot ID: P01374
  ENSP ID: ENSP00000402413

SEQ ID NO: 47621 - protein, 205 aa, Homo sapiens; identical to SEQ ID NO: 47619
  Payload ID: 9634
  Gene Symbol: LTA
  Gene Name: lymphotoxin alpha
  Uniprot ID: P01374
  ENSP ID: ENSP00000403495

SEQ ID NO: 47622 - protein, 205 aa, Homo sapiens; identical to SEQ ID NO: 47615
  Payload ID: 9634
  Gene Symbol: LTA
  Gene Name: lymphotoxin alpha
  ENSP ID: ENSP00000407133

SEQ ID NO: 47623 - protein, 205 aa, Homo sapiens; identical to SEQ ID NO: 47619
  Payload ID: 9634
  Gene Symbol: LTA
  Gene Name: lymphotoxin alpha
  Uniprot ID: P01374
  ENSP ID: ENSP00000412555

SEQ ID NO: 47624 - protein, 205 aa, Homo sapiens; identical to SEQ ID NO: 47619
  Payload ID: 9634
  Gene Symbol: LTA
  Gene Name: lymphotoxin alpha
  Uniprot ID: P01374
  ENSP ID: ENSP00000413450

SEQ ID NO: 47625 - protein, 205 aa, Homo sapiens; identical to SEQ ID NO: 47615
  Payload ID: 9634
  Gene Symbol: LTA
  Gene Name: lymphotoxin alpha
  ENSP ID: ENSP00000416337

SEQ ID NO: 47626 - protein, 205 aa, Homo sapiens; identical to SEQ ID NO: 47619
  Payload ID: 9634
  Gene Symbol: LTA
  Gene Name: lymphotoxin alpha
  Uniprot ID: P01374
  ENSP ID: ENSP00000416509

SEQ ID NO: 47627 - protein, 244 aa, Homo sapiens
  Payload ID: 9635
  Gene Symbol: LTB
  Gene Name: lymphotoxin beta (TNF superfamily, member 3)
  Uniprot ID: Q06643
  ENSP ID: ENSP00000365285
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 47628 - protein, 244 aa, Homo sapiens; identical to SEQ ID NO: 47627
  Payload ID: 9635
  Gene Symbol: LTB
  Gene Name: lymphotoxin beta (TNF superfamily, member 3)
  Uniprot ID: Q06643
  ENSP ID: ENSP00000372985

SEQ ID NO: 47629 - protein, 244 aa, Homo sapiens; identical to SEQ ID NO: 47627
  Payload ID: 9635
  Gene Symbol: LTB
  Gene Name: lymphotoxin beta (TNF superfamily, member 3)
  Uniprot ID: Q06643
  ENSP ID: ENSP00000393693

SEQ ID NO: 47630 - protein, 244 aa, Homo sapiens; identical to SEQ ID NO: 47627
  Payload ID: 9635
  Gene Symbol: LTB
  Gene Name: lymphotoxin beta (TNF superfamily, member 3)
  Uniprot ID: Q06643
  ENSP ID: ENSP00000395102

SEQ ID NO: 47631 - protein, 244 aa, Homo sapiens; identical to SEQ ID NO: 47627
  Payload ID: 9635
  Gene Symbol: LTB
  Gene Name: lymphotoxin beta (TNF superfamily, member 3)
  Uniprot ID: Q06643
  ENSP ID: ENSP00000398741

SEQ ID NO: 47632 - protein, 244 aa, Homo sapiens; identical to SEQ ID NO: 47627
  Payload ID: 9635
  Gene Symbol: LTB
  Gene Name: lymphotoxin beta (TNF superfamily, member 3)
  Uniprot ID: Q06643
  ENSP ID: ENSP00000404014

SEQ ID NO: 47633 - protein, 244 aa, Homo sapiens; identical to SEQ ID NO: 47627
  Payload ID: 9635
  Gene Symbol: LTB
  Gene Name: lymphotoxin beta (TNF superfamily, member 3)
  Uniprot ID: Q06643
  ENSP ID: ENSP00000404450

SEQ ID NO: 47634 - protein, 244 aa, Homo sapiens; identical to SEQ ID NO: 47627
  Payload ID: 9635
  Gene Symbol: LTB
  Gene Name: lymphotoxin beta (TNF superfamily, member 3)
  Uniprot ID: Q06643
  ENSP ID: ENSP00000410481

SEQ ID NO: 47635 - protein, 77 aa, Homo sapiens
  Payload ID: 9635
  Gene Symbol: LTB
  Gene Name: lymphotoxin beta (TNF superfamily, member 3)
  Uniprot ID: Q06643
  ENSP ID: ENSP00000416113
MGALGLEGRGGRLQGRGSLLLAVAGATSLVTLLLAVPITVLAVLALVPQDQGGLGFRSCQRRSQKQISAPGSQLPTS

SEQ ID NO: 47636 - protein, 435 aa, Homo sapiens
  Payload ID: 9636
  Gene Symbol: LTBR
  Gene Name: lymphotoxin beta receptor (TNFR superfamily, member 3)
  Uniprot ID: P36941
  ENSP ID: ENSP00000228918
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 47637 - protein, 217 aa, Homo sapiens
  Payload ID: 9636
  Gene Symbol: LTBR
  Gene Name: lymphotoxin beta receptor (TNFR superfamily, member 3)
  ENSP ID: ENSP00000437647
MLLPWATSAPGLAWGPLVLGLFGLLAASQPQAVPPYASENQTCRDQEKEYYEPQHRICCSRCPPAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMS

SEQ ID NO: 47638 - protein, 148 aa, Homo sapiens
  Payload ID: 9636
  Gene Symbol: LTBR
  Gene Name: lymphotoxin beta receptor (TNFR superfamily, member 3)
  ENSP ID: ENSP00000437954
MGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSEPALSKGVENLQALLYQAATGSSEASFPTLSPL

SEQ ID NO: 47639 - protein, 292 aa, Homo sapiens
  Payload ID: 9636
  Gene Symbol: LTBR
  Gene Name: lymphotoxin beta receptor (TNFR superfamily, member 3)
  ENSP ID: ENSP00000438605
MGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 47640 - protein, 74 aa, Homo sapiens
  Payload ID: 9636
  Gene Symbol: LTBR
  Gene Name: lymphotoxin beta receptor (TNFR superfamily, member 3)
  ENSP ID: ENSP00000438955
MGLEEIAPCTSKRKTQCRCQPGMFCAAWALECTHCELLSDCPPGTEAELKGVRTKVWWRQLQALPSPTQPAKIH

SEQ ID NO: 47641 - protein, 416 aa, Homo sapiens
  Payload ID: 9636
  Gene Symbol: LTBR
  Gene Name: lymphotoxin beta receptor (TNFR superfamily, member 3)
  Uniprot ID: P36941
  ENSP ID: ENSP00000440875
MEATGISLASQLKVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 47642 - protein, 150 aa, Homo sapiens
  Payload ID: 9637
  Gene Symbol: LYN
  Gene Name: LYN proto-oncogene, Src family tyrosine kinase
  ENSP ID: ENSP00000428313
MGCIKSKGKDSLSDDGVDLKTQPVRNTERTIYVRDPTSNKQQRPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSA

SEQ ID NO: 47643 - protein, 491 aa, Homo sapiens
  Payload ID: 9637
  Gene Symbol: LYN
  Gene Name: LYN proto-oncogene, Src family tyrosine kinase
  Uniprot ID: P07948
  ENSP ID: ENSP00000428424
MGCIKSKGKDSLSDDGVDLKTQPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 47644 - protein, 512 aa, Homo sapiens
  Payload ID: 9637
  Gene Symbol: LYN
  Gene Name: LYN proto-oncogene, Src family tyrosine kinase
  Uniprot ID: P07948
  ENSP ID: ENSP00000428924
MGCIKSKGKDSLSDDGVDLKTQPVRNTERTIYVRDPTSNKQQRPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 47645 - protein, 122 aa, Homo sapiens
  Payload ID: 9638
  Gene Symbol: LYRM1
  Gene Name: LYR motif containing 1
  Uniprot ID: O43325
  ENSP ID: ENSP00000219168
MTTATRQEVLGLYRSIFRLARKWQATSGQMEDTIKEKQYILNEARTLFRKNKNLTDTDLIKQCIDECTARIEIGLHYKIPYPRPIHLPPMGLTPLRGRGLRSQEKLRKLSKPVYLRSHDEVS

SEQ ID NO: 47646 - protein, 122 aa, Homo sapiens; identical to SEQ ID NO: 47645
  Payload ID: 9638
  Gene Symbol: LYRM1
  Gene Name: LYR motif containing 1
  Uniprot ID: O43325
  ENSP ID: ENSP00000379367

SEQ ID NO: 47647 - protein, 33 aa, Homo sapiens
  Payload ID: 9638
  Gene Symbol: LYRM1
  Gene Name: LYR motif containing 1
  ENSP ID: ENSP00000396868
MGLTPLRGRGLRSQEKLRKLSKPVYLRSHDEVS

SEQ ID NO: 47648 - protein, 122 aa, Homo sapiens; identical to SEQ ID NO: 47645
  Payload ID: 9638
  Gene Symbol: LYRM1
  Gene Name: LYR motif containing 1
  Uniprot ID: O43325
  ENSP ID: ENSP00000407883

SEQ ID NO: 47649 - protein, 122 aa, Homo sapiens; identical to SEQ ID NO: 47645
  Payload ID: 9638
  Gene Symbol: LYRM1
  Gene Name: LYR motif containing 1
  Uniprot ID: O43325
  ENSP ID: ENSP00000454551

SEQ ID NO: 47650 - protein, 33 aa, Homo sapiens; identical to SEQ ID NO: 47647
  Payload ID: 9638
  Gene Symbol: LYRM1
  Gene Name: LYR motif containing 1
  ENSP ID: ENSP00000454759

SEQ ID NO: 47651 - protein, 122 aa, Homo sapiens; identical to SEQ ID NO: 47645
  Payload ID: 9638
  Gene Symbol: LYRM1
  Gene Name: LYR motif containing 1
  Uniprot ID: O43325
  ENSP ID: ENSP00000454826

SEQ ID NO: 47652 - protein, 107 aa, Homo sapiens
  Payload ID: 9638
  Gene Symbol: LYRM1
  Gene Name: LYR motif containing 1
  ENSP ID: ENSP00000454890
MTTATRQEVLGLYRSIFRLARKWQATSGQMEDTIKEKQYILNEARTLFRKNKNLTDTDLIKQCIDECTARIEIGLHYKIPYPRPVSVTPVNKCWVLTLINLVISKNV

SEQ ID NO: 47653 - protein, 122 aa, Homo sapiens; identical to SEQ ID NO: 47645
  Payload ID: 9638
  Gene Symbol: LYRM1
  Gene Name: LYR motif containing 1
  Uniprot ID: O43325
  ENSP ID: ENSP00000457333

SEQ ID NO: 47654 - protein, 107 aa, Homo sapiens; identical to SEQ ID NO: 47652
  Payload ID: 9638
  Gene Symbol: LYRM1
  Gene Name: LYR motif containing 1
  ENSP ID: ENSP00000457743

SEQ ID NO: 47655 - protein, 77 aa, Homo sapiens
  Payload ID: 9639
  Gene Symbol: LYRM2
  Gene Name: LYR motif containing 2
  ENSP ID: ENSP00000427859
MAASRLPPATLTLKQFVRRQQVLLLYRRILQTIRQVPNDSDRKYLKDWAREEFRRNKSATEEVRTKSWLRPRLKRKT

SEQ ID NO: 47656 - protein, 72 aa, Homo sapiens
  Payload ID: 9639
  Gene Symbol: LYRM2
  Gene Name: LYR motif containing 2
  ENSP ID: ENSP00000428207
MAASRLPPATLTLKQFVRRQQVLLLYRRILQTIRQVPNDSDRKYLKDWAREEFRRNKSATEEVRTKSWIQSG

SEQ ID NO: 47657 - protein, 88 aa, Homo sapiens
  Payload ID: 9639
  Gene Symbol: LYRM2
  Gene Name: LYR motif containing 2
  Uniprot ID: Q9NU23
  ENSP ID: ENSP00000430025
MAASRLPPATLTLKQFVRRQQVLLLYRRILQTIRQVPNDSDRKYLKDWAREEFRRNKSATEEDTIRMMITQGNMQLKELEKTLALAKS

SEQ ID NO: 47658 - protein, 98 aa, Homo sapiens
  Payload ID: 9639
  Gene Symbol: LYRM2
  Gene Name: LYR motif containing 2
  ENSP ID: ENSP00000430316
MAASRLPPATLTLKQFVRRQQVLLLYRRILQTIRQVPNDSDRKYLKDWAREEFRRNKSATEEASPTTEAQDLKEANGIVTTTGVRSICVREFSLDLGL

SEQ ID NO: 47659 - protein, 98 aa, Homo sapiens; identical to SEQ ID NO: 47658
  Payload ID: 9639
  Gene Symbol: LYRM2
  Gene Name: LYR motif containing 2
  ENSP ID: ENSP00000486073

SEQ ID NO: 47660 - protein, 74 aa, Homo sapiens
  Payload ID: 9640
  Gene Symbol: LYRM4
  Gene Name: LYR motif containing 4
  ENSP ID: ENSP00000417885
  MOD_RES (1)..(1): Any amino acid
XTYAVRRIRDAFRENKNVKDPVEIQTLVNKAKRDLGVIRRQITESRSVTQAGVQWRDLSNLHLPGSNHSSASAS

SEQ ID NO: 47661 - protein, 40 aa, Homo sapiens
  Payload ID: 9640
  Gene Symbol: LYRM4
  Gene Name: LYR motif containing 4
  ENSP ID: ENSP00000418321
MAASSRAQVLSLYRAMLRESKRFSAYNYRSTLANCIQLTS

SEQ ID NO: 47662 - protein, 91 aa, Homo sapiens
  Payload ID: 9640
  Gene Symbol: LYRM4
  Gene Name: LYR motif containing 4
  Uniprot ID: Q9HD34
  ENSP ID: ENSP00000418787
MAASSRAQVLSLYRAMLRESKRFSAYNYRTYAVRRIRDAFRENKNVKDPVEIQTLVNKAKRDLGVIRRQVHIGQLYSTDKLIIENRDMPRT

SEQ ID NO: 47663 - protein, 70 aa, Homo sapiens
  Payload ID: 9640
  Gene Symbol: LYRM4
  Gene Name: LYR motif containing 4
  ENSP ID: ENSP00000419928
MAASSRAQVLSLYRAMLRESKRFSAYNYRTYAVRRIRDAFRENKNVKDPVEIQTLVNKAKRDLGVIRRQA

SEQ ID NO: 47664 - protein, 96 aa, Homo sapiens
  Payload ID: 9640
  Gene Symbol: LYRM4
  Gene Name: LYR motif containing 4
  ENSP ID: ENSP00000420026
MAASSRAQVLSLYRAMLRESKRFSAYNYRTYAVRRIRDAFRENKNVKDPVEIQTLVNKAKRDLGVIRRQVAEQGTAARRKSGNSSRSLGKPCTSWP

SEQ ID NO: 47665 - protein, 130 aa, Homo sapiens
  Payload ID: 9640
  Gene Symbol: LYRM4
  Gene Name: LYR motif containing 4
  ENSP ID: ENSP00000443900
MAASSRAQVLSLYRAMLRESKRFSAYNYRTYAVRRIRDAFRENKNVKDPVEIQTLVNKAKRDLGVIRRQMDSHSVAQAGVHWNDLSSLQPLPPWFKQFSCLSLPSSWDYRRTPPRLANFCILSRDVISLY

SEQ ID NO: 47666 - protein, 90 aa, Homo sapiens
  Payload ID: 9641
  Gene Symbol: LYRM5
  Gene Name: LYR motif containing 5
  Uniprot ID: Q6IPR1
  ENSP ID: ENSP00000370761
MKMANSLRGEVLKLYKNLLYLGRDYPKGADYFKKRLKNIFLKNKDVKNPEKIKELIAQGEFVMKELEALYFLRKYRAMKQRYYSDTNKTN

SEQ ID NO: 47667 - protein, 88 aa, Homo sapiens
  Payload ID: 9641
  Gene Symbol: LYRM5
  Gene Name: LYR motif containing 5
  ENSP ID: ENSP00000450443
MANSLRGEVLKLYKNLLYLGRDYPKGADYFKKRLKNIFLKNKDVKNPEKIKELIAQGEFVMKELEALYFLRKYRAMKQRYYSDTNKTN

SEQ ID NO: 47668 - protein, 88 aa, Homo sapiens; identical to SEQ ID NO: 47667
  Payload ID: 9641
  Gene Symbol: LYRM5
  Gene Name: LYR motif containing 5
  ENSP ID: ENSP00000450584

SEQ ID NO: 47669 - protein, 38 aa, Homo sapiens
  Payload ID: 9641
  Gene Symbol: LYRM5
  Gene Name: LYR motif containing 5
  ENSP ID: ENSP00000451008
MANSLRGEVLKLYKNKYIIFLFEAAVSWTRLSKRSRLF

SEQ ID NO: 47670 - protein, 88 aa, Homo sapiens; identical to SEQ ID NO: 47667
  Payload ID: 9641
  Gene Symbol: LYRM5
  Gene Name: LYR motif containing 5
  ENSP ID: ENSP00000451494

SEQ ID NO: 47671 - protein, 41 aa, Homo sapiens [sequence omitted]

SEQ ID NO: 47672 - protein, 37 aa, Homo sapiens
  Payload ID: 9641
  Gene Symbol: LYRM5
  Gene Name: LYR motif containing 5
  ENSP ID: ENSP00000451938
MANSLRGEVLKLYKNKKYNILGRVTMTNSSGKETKPL

SEQ ID NO: 47673 - protein, 34 aa, Homo sapiens
  Payload ID: 9641
  Gene Symbol: LYRM5
  Gene Name: LYR motif containing 5
  ENSP ID: ENSP00000452130
MANSLRGEVLKLYKNLLYLGRDYPKGADYFKKRL

SEQ ID NO: 47674 - protein, 88 aa, Homo sapiens; identical to SEQ ID NO: 47667
  Payload ID: 9641
  Gene Symbol: LYRM5
  Gene Name: LYR motif containing 5
  ENSP ID: ENSP00000452146

SEQ ID NO: 47675 - protein, 41 aa, Homo sapiens [sequence omitted]

SEQ ID NO: 47676 - protein, 104 aa, Homo sapiens
  Payload ID: 9642
  Gene Symbol: LYRM7
  Gene Name: LYR motif containing 7
  Uniprot ID: Q5U5X0
  ENSP ID: ENSP00000368688
MGRAVKVLQLFKTLHRTRQQVFKNDARALEAARIKINEEFKNNKSETSSKKIEELMKIGSDVELLLRTSVIQGIHTDHNTLKLVPRKDLLVENVPYCDAPTQKQ

SEQ ID NO: 47677 - protein, 53 aa, Homo sapiens
  Payload ID: 9642
  Gene Symbol: LYRM7
  Gene Name: LYR motif containing 7
  ENSP ID: ENSP00000423283
MGRAVKVLQLFKTLHRTRQQVFKNDARALEELVPRKDLLVENVPYCDAPTQKQ

SEQ ID NO: 47678 - protein, 63 aa, Homo sapiens
  Payload ID: 9642
  Gene Symbol: LYRM7
  Gene Name: LYR motif containing 7
  ENSP ID: ENSP00000423991
MGRAVKVLQLFKTLHRTRQQVFKNDARALEAARIKINEEFKNNKSETSSKKIEENWSLGKTFL

SEQ ID NO: 47679 - protein, 78 aa, Homo sapiens
  Payload ID: 9643
  Gene Symbol: LYRM9
  Gene Name: LYR motif containing 9
  Uniprot ID: A8MSI8
  ENSP ID: ENSP00000368396
MAPLPGAELVRRPLQLYRYLLRCCQQLPTKGIQQHYKHAVRQSFRVHSDEDNPERIQQIIKRAIEDADWIMNKYKKQN

SEQ ID NO: 47680 - protein, 78 aa, Homo sapiens; identical to SEQ ID NO: 47679
  Payload ID: 9643
  Gene Symbol: LYRM9
  Gene Name: LYR motif containing 9
  Uniprot ID: A8MSI8
  ENSP ID: ENSP00000368397

SEQ ID NO: 47681 - protein, 86 aa, Homo sapiens
  Payload ID: 9643
  Gene Symbol: LYRM9
  Gene Name: LYR motif containing 9
  ENSP ID: ENSP00000421807
MAPLPGAELVRRPLQLYRYLLRCCQQLPTKGIQQHYKHAVRQSFRVHSDEDNPERIQQIIKRAIEDADWIMNKVGAWPLGSACELG

SEQ ID NO: 47682 - protein, 92 aa, Homo sapiens
  Payload ID: 9643
  Gene Symbol: LYRM9
  Gene Name: LYR motif containing 9
  ENSP ID: ENSP00000426554
MAPLPGAELVRRPLQLYRYLLRCCQQLPTKGIQQHYKHAVRQSFRVHSDEDNPERIQQIIKRAIEDADWIMNKLRMVPVEEATSQLLPSSRS

SEQ ID NO: 47683 - protein, 27 aa, Homo sapiens
  Payload ID: 9643
  Gene Symbol: LYRM9
  Gene Name: LYR motif containing 9
  ENSP ID: ENSP00000463472
MAPLPGAELVRRPLQLYRYLLRCCQQL

SEQ ID NO: 47684 - protein, 86 aa, Homo sapiens; identical to SEQ ID NO: 47681
  Payload ID: 9643
  Gene Symbol: LYRM9
  Gene Name: LYR motif containing 9
  ENSP ID: ENSP00000464378

SEQ ID NO: 47685 - protein, 852 aa, Homo sapiens
  Payload ID: 9644
  Gene Symbol: KDM1A
  Gene Name: lysine (K)-specific demethylase 1A
  Uniprot ID: O60341
  ENSP ID: ENSP00000349049
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 47686 - protein, 876 aa, Homo sapiens
  Payload ID: 9644
  Gene Symbol: KDM1A
  Gene Name: lysine (K)-specific demethylase 1A
  Uniprot ID: O60341
  ENSP ID: ENSP00000383042
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGQAGGLQDDSSGGYGDGQASGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQADTVKVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 47687 - protein, 301 aa, Homo sapiens
  Payload ID: 9644
  Gene Symbol: KDM1A
  Gene Name: lysine (K)-specific demethylase 1A
  ENSP ID: ENSP00000473294
DFEFTGSHLTVRNGYSCVPVALAEGLDIKLNTAVRQVRYTASVFSHPTSAGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQS

SEQ ID NO: 47688 - protein, 189 aa, Homo sapiens
  Payload ID: 9644
  Gene Symbol: KDM1A
  Gene Name: lysine (K)-specific demethylase 1A
  ENSP ID: ENSP00000473297
EYDELAETQGKLEEKLQELEANPPSPLFFCSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSV

SEQ ID NO: 47689 - protein, 590 aa, Homo sapiens
  Payload ID: 9645
  Gene Symbol: KDM1B
  Gene Name: lysine (K)-specific demethylase 1B
  Uniprot ID: Q8NB78
  ENSP ID: ENSP00000297792
MATPRGRTKKKASFDHSPDSLPLRSSGRQAKKKATETTDEDEDGGSEKKYRKCEKAGCTATCPVCFASASERCAKNGYTSRWYHLSCGEHFCNECFDHYYRSHKDGYDKYTTWKKIWTSNGKTEPSPKAFMADQQLPYWVQCTKPECRKWRQLTKEIQLTPQIAKTYRCGMKPNTAIKPETSDHCSLPEDLEALTPQKCIPHIIVRGLVRIRCVQEVERILYFMTRKGLINTGVLSVGADQYLLPKDYHNKSVIIIGAGPAGLAAARQLHNFGIKVTVLEAKDRIGGRVWDDKSFKGVTVGRGAQIVNGCINNPVALMCEQVSARSWDHNEFFAQFAGDHTLLTPGYSVIIEKLAEGLDIQLKSPVQCIDYSGDEVQVTTTDGTGYSAQKVLVTVPLALLQKGAIQFNPPLSEKKMKAINSLGAGIIEKIALQFPYRFWDSKVQGADFFGHVPPSASKRGLFAVFYDMDPQKKHSVLMSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 47690 - protein, 640 aa, Homo sapiens
  Payload ID: 9645
  Gene Symbol: KDM1B
  Gene Name: lysine (K)-specific demethylase 1B
  ENSP ID: ENSP00000405669
  MOD_RES (1)..(1): Any amino acid
XCSLPEDLRVLEVSNHWWYSMLILPPLLKDSVAAPLLSAYYPDCVGMSPSCTSTNRAAATGNASPGKLEHSKAALSVHVPGMNRYFQPFYQPNECGKALCVRPDVMELDELYEFPEYSRDPTMYLALRNLILALWYTNCKEALTPQKCIPHIIVRGLVRIRCVQEVERILYFMTRKGLINTGVLSVGADQYLLPKDYHNKSVIIIGAGPAGLAAARQLHNFGIKVTVLEAKDRIGGRVWDDKSFKGVTVGRGAQIVNGCINNPVALMCEQLGISMHKFGERCDLIQEGGRITDPTIDKRMDFHFNALLDVVSEWRKDKTQLQDVPLGEKIEEIYKAFIKESGIQFSELEGQVLQFHLSNLEYACGSNLHQVSARSWDHNEFFAQFAGDHTLLTPGYSVIIEKLAEGLDIQLKSPQVQCIDYSGDEVQVTTTDGTGYSAQKVLVTVPLALLQKGAIQFNPPLSEKKMKAINSLGAGIIEKIALQFPYRFWDSKVQGADFFGHVPPSASKRGLFAVFYDMDPQKKHSVLMSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 47691 - protein, 113 aa, Homo sapiens
  Payload ID: 9645
  Gene Symbol: KDM1B
  Gene Name: lysine (K)-specific demethylase 1B
  ENSP ID: ENSP00000442670
MSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 47692 - protein, 1145 aa, Homo sapiens
  Payload ID: 9646
  Gene Symbol: KDM2A
  Gene Name: lysine (K)-specific demethylase 2A
  ENSP ID: ENSP00000309302
MRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 47693 - protein, 782 aa, Homo sapiens
  Payload ID: 9646
  Gene Symbol: KDM2A
  Gene Name: lysine (K)-specific demethylase 2A
  Uniprot ID: Q9Y2K7
  ENSP ID: ENSP00000381640
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVLRQETLDKN

SEQ ID NO: 47694 - protein, 1162 aa, Homo sapiens
  Payload ID: 9646
  Gene Symbol: KDM2A
  Gene Name: lysine (K)-specific demethylase 2A
  Uniprot ID: Q9Y2K7
  ENSP ID: ENSP00000432786
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 47695 - protein, 723 aa, Homo sapiens
  Payload ID: 9646
  Gene Symbol: KDM2A
  Gene Name: lysine (K)-specific demethylase 2A
  Uniprot ID: Q9Y2K7
  ENSP ID: ENSP00000435776
MCSGRFQNIQVNPDFPRGRISNSFRRTSSTENKTKTLGKLHQEPRQLQSDGKRKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 47696 - protein, 1265 aa, Homo sapiens
  Payload ID: 9647
  Gene Symbol: KDM2B
  Gene Name: lysine (K)-specific demethylase 2B
  Uniprot ID: Q8NHM5
  ENSP ID: ENSP00000366269
MEAEKDSGRRLRPIDRQRYDENEDLSDVEEIVSVRGFSLEEKLRSQLYQGDFVHAMEGKDFNYEYVQREALRVPLIFREKDGLGIKMPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSDCNKVTDQCLSFFKRCGNICHIDLRYCKQVTKEGCEQFIAEMSSFQGRSCSTTRLGDE

SEQ ID NO: 47697 - protein, 1336 aa, Homo sapiens
  Payload ID: 9647
  Gene Symbol: KDM2B
  Gene Name: lysine (K)-specific demethylase 2B
  Uniprot ID: Q8NHM5
  ENSP ID: ENSP00000366271
MAGPQMGGSAEDHPPRKRHAAEKQKKKTVIYTKCFEFESATQRPIDRQRYDENEDLSDVEEIVSVRGFSLEEKLRSQLYQGDFVHAMEGKDFNYEYVQREALRVPLIFREKDGLGIKMPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSDCNKVTDQCLSFFKRCGNICHIDLRYCKQVTKEGCEQFIAEMSVSVQFGQVEEKLLQKLS

SEQ ID NO: 47698 - protein, 510 aa, Homo sapiens
  Payload ID: 9647
  Gene Symbol: KDM2B
  Gene Name: lysine (K)-specific demethylase 2B
  ENSP ID: ENSP00000398279
MRQLLRPIDRQRYDENEDLSDVEEIVSVRGFSLEEKLRSQLYQGDFVHAMEGKDFNYEYVQREALRVPLIFREKDGLGIKMPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEG

SEQ ID NO: 47699 - protein, 154 aa, Homo sapiens
  Payload ID: 9647
  Gene Symbol: KDM2B
  Gene Name: lysine (K)-specific demethylase 2B
  ENSP ID: ENSP00000437497
MSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQ

SEQ ID NO: 47700 - protein, 704 aa, Homo sapiens
  Payload ID: 9647
  Gene Symbol: KDM2B
  Gene Name: lysine (K)-specific demethylase 2B
  ENSP ID: ENSP00000437821
MKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSDCNKVTDQCLSFFKRCGNICHIDLRYCKQVTKEGCEQFIAEMSVSVQFGQVEEKLLQKLS

SEQ ID NO: 47701 - protein, 104 aa, Homo sapiens
  Payload ID: 9647
  Gene Symbol: KDM2B
  Gene Name: lysine (K)-specific demethylase 2B
  ENSP ID: ENSP00000438138
MAGPQMGGSAEDHPPRKRHAAEKQKKKTVIYTKCFEFESATQRPIDRQRYDENEDLSDVEEIVSVRGFSLEEKLRSQLYQGDFVHAMEGKGCLTLISQSETSNS

SEQ ID NO: 47702 - protein, 180 aa, Homo sapiens
  Payload ID: 9647
  Gene Symbol: KDM2B
  Gene Name: lysine (K)-specific demethylase 2B
  ENSP ID: ENSP00000440373
MPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQR

SEQ ID NO: 47703 - protein, 123 aa, Homo sapiens
  Payload ID: 9647
  Gene Symbol: KDM2B
  Gene Name: lysine (K)-specific demethylase 2B
  ENSP ID: ENSP00000440942
MSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTREKNKL

SEQ ID NO: 47704 - protein, 97 aa, Homo sapiens
  Payload ID: 9647
  Gene Symbol: KDM2B
  Gene Name: lysine (K)-specific demethylase 2B
  ENSP ID: ENSP00000442293
MSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGN

SEQ ID NO: 47705 - protein, 41 aa, Homo sapiens
  Payload ID: 9647
  Gene Symbol: KDM2B
  Gene Name: lysine (K)-specific demethylase 2B
  ENSP ID: ENSP00000443052
MWLKPFEGEGWKATTCLCSPNSVTPSTMRCAGMSWRDTCTV

SEQ ID NO: 47706 - protein, 125 aa, Homo sapiens
  Payload ID: 9647
  Gene Symbol: KDM2B
  Gene Name: lysine (K)-specific demethylase 2B
  ENSP ID: ENSP00000444846
MLPGLSRGHRRRGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEE

SEQ ID NO: 47707 - protein, 171 aa, Homo sapiens
  Payload ID: 9647
  Gene Symbol: KDM2B
  Gene Name: lysine (K)-specific demethylase 2B
  ENSP ID: ENSP00000445102
MSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGF

SEQ ID NO: 47708 - protein, 706 aa, Homo sapiens [sequence omitted]

SEQ ID NO: 47709 - protein, 507 aa, Homo sapiens
  Payload ID: 9647
  Gene Symbol: KDM2B
  Gene Name: lysine (K)-specific demethylase 2B
  ENSP ID: ENSP00000474307
MAGPQMGGSAEDHPPRKRHAAEKQKKKTVIYTKCFEFESATQRPIDRQRYDENEDLSDVEEIVSVRGFSLEEKLRSQLYQGDFVHAMEGKDFNYEYVQREALRVPLIFREKDGLGIKMPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKVRRSLPAAGGRFPPPSHLL

SEQ ID NO: 47710 - protein, 559 aa, Homo sapiens
  Payload ID: 9647
  Gene Symbol: KDM2B
  Gene Name: lysine (K)-specific demethylase 2B
  Uniprot ID: Q8NHM5
  ENSP ID: ENSP00000480847
MPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIATAIRSLISACPSSNAVETSVILT

SEQ ID NO: 47711 - protein, 1321 aa, Homo sapiens
  Payload ID: 9648
  Gene Symbol: KDM3A
  Gene Name: lysine (K)-specific demethylase 3A
  Uniprot ID: Q9Y4C1
  ENSP ID: ENSP00000323659
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEFQALIVKHLDESHLLKGDKNLVGSEVKIYSLDPSTQWFSATVINGNPASKTLQVNCEEIPALKIVDPSLIHVEVVHDNLVTCGNSARIGAVKRKSSENNGTLVSKQAKSCSEASPSMCPVQSVPTTVFKEILLGCTAATPPSKDPRQQSTPQAANSPPNLGAKIPQGCHKQSLPEEISSCLNTKSEALRTKPDVCKAGLLSKSSQIGTGDLKILTEPKGSCTQPKTNTDQENRLESVPQALTGLPKECLPTKASSKAELEIANPPELQKHLEHAPSPSDVSNAPEVKAGVNSDSPNNCSGKKVEPSALACRSQNLKESSVKVDNESCCSRSNNKIQNAPSRKSVLTDPAKLKKLQQSGEAFVQDDSCVNIVAQLPKCRECRLDSLRKDKEQQKDSPVFCRFFHFRRLQFNKHGVLRVEGFLTPNKYDNEAIGLWLPLTKNVVGIDLDTAKYILANIGDHFCQMVISEKEAMSTIEPHRQVAWKRAVKGVREMCDVCDTTIFNLHWVCPRCGFGVCVDCYRMKRKNCQQGAAYKTFSWLKCVKSQIHEPENLMPTQIIPGKALYDVGDIVHSVRAKWGIKANCPCSNRQFKLFSKPASKEDLKQTSLAGEKPTLGAVLQQNPSVLEPAAVGGEAASKPAGSMKPACPASTSPLNWLADLTSGNVNKENKEKQPTMPILKNEIKCLPPLPPLSKSSTVLHTFNSTILTPVSNNNSGFLRNLLNSSTGKTENGLKNTPKILDDIFASLVQNKTTSDLSKRPQGLTIKPSILGFDTPHYWLCDNRLLCLQDPNNKSNWNVFRECWKQGQPVMVSGVHHKLNSELWKPESFRKEFGEQEVDLVNCRTNEIITGATVGDFWDGFEDVPNRLKNEKEPMVLKLKDWPPGEDFRDMMPSRFDDLMANIPLPEYTRRDGKLNLASRLPNYFVRPDLGPKMYNAYGLITPEDRKYGTTNLHLDVSDAANVMVYVGIPKGQCEQEEEVLKTIQDGDSDELTIKRFIEGKEKPGALWHIYAAKDTEKIREFLKKVSEEQGQENPADHDPIHDQSWYLDRSLRKRLHQEYGVQGWAIVQFLGDVVFIPAGAPHQVHNLYSCIKVAEDFVSPEHVKHCFWLTQEFRYLSQTHTNHEDKLQVKNVIYHAVKDAVAMLKASESSFGKP

SEQ ID NO: 47712 - protein, 1321 aa, Homo sapiens; identical to SEQ ID NO: 47711
  Payload ID: 9648
  Gene Symbol: KDM3A
  Gene Name: lysine (K)-specific demethylase 3A
  Uniprot ID: Q9Y4C1
  ENSP ID: ENSP00000386516

SEQ ID NO: 47713 - protein, 1321 aa, Homo sapiens; identical to SEQ ID NO: 47711
  Payload ID: 9648
  Gene Symbol: KDM3A
  Gene Name: lysine (K)-specific demethylase 3A
  Uniprot ID: Q9Y4C1
  ENSP ID: ENSP00000386660

SEQ ID NO: 47714 - protein, 711 aa, Homo sapiens
  Payload ID: 9648
  Gene Symbol: KDM3A
  Gene Name: lysine (K)-specific demethylase 3A
  ENSP ID: ENSP00000394691
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEFQALIVKHLDESHLLKGDKNLVGSEVKIYSLDPSTQWFSATVINGNPASKTLQVNCEEIPALKIVDPSLIHVEVVHDNLVTCGNSARIGAVKRKSSENNGTLVSKQAKSCSEASPSMCPVQSVPTTVFKEILLGCTAATPPSKDPRQQSTPQAANSPPNLGAKIPQGCHKQSLPEEISSCLNTKSEALRTKPDVCKAGLLSKSSQIGTGDLKILTEPKGSCTQPKTNTDQENRLESVPQALTGLPKECLPTKASSKAELEIANPPELQKHLEHAPSPSDVSNAPEVKAGVNSDSPNNCSGKKVEPSALACRSQNLKESSVKVDNESCCSRSNNKIQNAPSRKSVLTDPAKLKKLQQSGEAFVQDDSCVNIVAQLPKCRECRLDSLRKDKEQQKDSPVFCRFFHFRRLQFNKHGVLRVEGFLTPNKYDNEAIGLWLPLTKNVVGIDLDTAKYILANIGDHFCQMVISEKEAMSTIEPHRQVAWKRAVKGVREMCDVCDTTIFNLHWVCPRCGFGVCVDCYRMKRKNCQQGENRFDSPPAPLHS

SEQ ID NO: 47715 - protein, 121 aa, Homo sapiens
  Payload ID: 9648
  Gene Symbol: KDM3A
  Gene Name: lysine (K)-specific demethylase 3A
  ENSP ID: ENSP00000396561
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLD

SEQ ID NO: 47716 - protein, 170 aa, Homo sapiens
  Payload ID: 9648
  Gene Symbol: KDM3A
  Gene Name: lysine (K)-specific demethylase 3A
  ENSP ID: ENSP00000397660
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEF

SEQ ID NO: 47717 - protein, 1327 aa, Homo sapiens
  Payload ID: 9648
  Gene Symbol: KDM3A
  Gene Name: lysine (K)-specific demethylase 3A
  ENSP ID: ENSP00000438324
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEFQALIVKHLDESHLLKGDKNLVGSEVKIYSLDPSTQWFSATVINGNPASKTLQVNCEEIPALKIVDPSLIHVEVVHDNLVTCGNSARIGAVKRKSSENNGTLVSKQAKSCSEASPSMCPVQSVPTTVFKEILLGCTAATPPSKDPRQQSTPQAANSPPNLGAKIPQGCHKQSLPEEISSCLNTKSEALRTKPDVCKAGLLSKSSQIGTGDLKILTEPKGSCTQPKTNTDQENRLESVPQALTGLPKECLPTKASSKAELEIANPPELQKHLEHAPSPSDVSNAPEVKAGVNSDSPNNCSGKKVEPSALACRSQNLKESSVKVDNESCCSRSNNKIQNAPSRKSVLTDPAKLKKLQQSGEAFVQDDSCVNIVAQLPKCRECRLDSLRKDKEQQKDSPVFCRFFHFRRLQFNKHGVLRVEGFLTPNKYDNEAIGLWLPLTKNVVGIDLDTAKYILANIGDHFCQMVISEKEAMSTIEPHRQVAWKRAVKGVREMCDVCDTTIFNLHWVCPRCGFGVCVDCYRMKRKNCQQGAAYKTFSWLKCVKSQIHEPENLMPTQIIPGKALYDVGDIVHSVRAKWGIKANCPCSNRQFKLFSKPASKEDLKQTSLAGEKPTLGAVLQQNPSVLEPAAVGGEAASKPAGSMKPACPASTSPLNWLADLTSGNVNKENKEKQPTMPILKNEIKCLPPLPPLSKSSTVLHTFNSTILTPVSNNNSGFLRNLLNSSTGKTENGLKNTPKILDDIFASLVQNKTTSDLSKRPQGLTIKPSILGFDTPHYWLCDNRLLCLQDPNNKSNWNVFRECWKQGQPVMVSGVHHKLNSELWKPESFRKEFGEQEVDLVNCRTNEIITGATVGDFWDGFEDVPNRLKNEKEPMVLKLKDWPPGEDFRDMMPSRFDDLMANIPLPEYTRRDGKLNLASRLPNYFVRPDLGPKMYNAYGLITPEDRKYGTTNLHLDVSDAANVMVYVGIPKGQCEQEEEVLKTIQDGDSDELTIKRFIEGKEKPGALWHIYAAKDTEKIREFLKKVSEEQGQENPADHDPIHDQSWYLDRSLRKRLHQEYGVQGWAIVQFLGDVVFIPAGAPHQVHNLYSCIKVAEDFVSPEHVKHCFWLTQEFRYLSQTHTNHEDKLQVKNVIYHAVKDAVAMLKVNPVLANLNLPAHWK

SEQ ID NO: 47718 - protein, 1761 aa, Homo sapiens
  Payload ID: 9649
  Gene Symbol: KDM3B
  Gene Name: lysine (K)-specific demethylase 3B
  Uniprot ID: Q7LBC6
  ENSP ID: ENSP00000326563
MADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSAPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 47719 - protein, 20 aa, Homo sapiens
  Payload ID: 9649
  Gene Symbol: KDM3B
  Gene Name: lysine (K)-specific demethylase 3B
  ENSP ID: ENSP00000423012
VPEKQKGSRSQASGELASQC

SEQ ID NO: 47720 - protein, 274 aa, Homo sapiens
  Payload ID: 9649
  Gene Symbol: KDM3B
  Gene Name: lysine (K)-specific demethylase 3B
  ENSP ID: ENSP00000425186
IFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSAPQSEGGTLKAVKSSKGKKKRESIEGKDGRRRKSASDSGCDPASKKLKGDRGEVDSNGSDGDKPQHSLCHLHQRKRQDSGGAG

SEQ ID NO: 47721 - protein, 759 aa, Homo sapiens
  Payload ID: 9649
  Gene Symbol: KDM3B
  Gene Name: lysine (K)-specific demethylase 3B
  Uniprot ID: Q7LBC6
  ENSP ID: ENSP00000439462
MSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 47722 - protein, 1064 aa, Homo sapiens
  Payload ID: 9650
  Gene Symbol: KDM4A
  Gene Name: lysine (K)-specific demethylase 4A
  Uniprot ID: O75164
  ENSP ID: ENSP00000361473
MASESETLNPSARIMTFYPTMEEFRNFSRYIAYIESQGAHRAGLAKVVPPKEWKPRASYDDIDDLVIPAPIQQLVTGQSGLFTQYNIQKKAMTVREFRKIANSDKYCTPRYSEFEELERKYWKNLTFNPPIYGADVNGTLYEKHVDEWNIGRLRTILDLVEKESGITIEGVNTPYLYFGMWKTSFAWHTEDMDLYSINYLHFGEPKSWYSVPPEHGKRLERLAKGFFPGSAQSCEAFLRHKMTLISPLMLKKYGIPFDKVTQEAGEFMITFPYGYHAGFNHGFNCAESTNFATRRWIEYGKQAVLCSCRKDMVKISMDVFVRKFQPERYKLWKAGKDNTVIDHTLPTPEAAEFLKESELPPRAGNEEECPEEDMEGVEDGEEGDLKTSLAKHRIGTKRHRVCLEIPQEVSQSELFPKEDLSSEQYEMTECPAALAPVRPTHSSVRQVEDGLTFPDYSDSTEVKFEELKNVKLEEEDEEEEQAAAALDLSVNPASVGGRLVFSGSKKKSSSSLGSGSSRDSISSDSETSEPLSCRAQGQTGVLTVHSYAKGDGRVTVGEPCTRKKGSAARSFSERELAEVADEYMFSLEENKKSKGRRQPLSKLPRHHPLVLQECVSDDETSEQLTPEEEAEETEAWAKPLSQLWQNRPPNFEAEKEFNETMAQQAPHCAVCMIFQTYHQVEFGGFNQNCGNASDLAPQKQRTKPLIPEMCFTSTGCSTDINLSTPYLEEDGTSILVSCKKCSVRVHASCYGVPPAKASEDWMCSRCSANALEEDCCLCSLRGGALQRANDDRWVHVSCAVAILEARFVNIAERSPVDVSKIPLPRFKLKCIFCKKRRKRTAGCCVQCSHGRCPTAFHVSCAQAAGVMMQPDDWPFVVFITCFRHKIPNLERAKGALQSITAGQKVISKHKNGRFYQCEVVRLTTETFYEVNFDDGSFSDNLYPEDIVSQDCLQFGPPAEGEVVQVRWTDGQVYGAKFVASHPIQMYQVEFEDGSQLVVKRDDVYTLDEELPKRVKSRLSVASDMRFNEIFTEKEVKQEKKRQRVINSRYREDYIEPALYRAIME

SEQ ID NO: 47723 - protein, 1096 aa, Homo sapiens
  Payload ID: 9651
  Gene Symbol: KDM4B
  Gene Name: lysine (K)-specific demethylase 4B
  ENSP ID: ENSP00000159111
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQCTCRKDMVKISMDVFVRILQPERYELWKQGKDLTVLDHTRPTALTSPELSSWSASRASLKAKLLRRSHRKRSQPKKPKPEDPKFPGEGTAGAALLEEAGGSVKEEAGPEVDPEEEEEEPQPLPHGREAEGAEEDGRGKLRPTKAKSERKKKSFGLLPPQLPPPPAHFPSEEALWLPSPLEPPVLGPGPAAMEESPLPAPLNVVPPEVPSEELEAKPRPIIPMLYVVPRPGKAAFNQEHVSCQQAFEHFAQKGPTWKEPVSPMELTGPEDGAASSGAGRMETKARAGEGQAPSTFSKLKMEIKKSRRHPLGRPPTRSPLSVVKQEASSDEEASPFSGEEDVSDPDALRPLLSLQWKNRAASFQAERKFNAAAARTEPYCAICTLFYPYCQALQTEKEAPIASLGEGCPATLPSKSRQKTRPLIPEMCFTSGGENTEPLPANSYIGDDGTSPLIACGKCCLQVHASCYGIRPELVNEGWTCSRCAAHAWTAECCLCNLRGGALQMTTDRRWIHVICAIAVPEARFLNVIERHPVDISAIPEQRWKLKCVYCRKRMKKVSGACIQCSYEHCSTSFHVTCAHAAGVLMEPDDWPYVVSITCLKHKSGGHAVQLLRAVSLGQVVITKNRNGLYYRCRVIGAASQTCYEVNFDDGSYSDNLYPESITSRDCVQLGPPSEGELVELRWTDGNLYKAKFISSVTSHIYQVEFEDGSQLTVKRGDIFTLEEELPKRVRSRLSLSTGAPQEPAFSGEEAKAAKRPRVGTPLATEDSGRSQDYVAFVESLLQVQGRPGAPF

SEQ ID NO: 47724 - protein, 448 aa, Homo sapiens
  Payload ID: 9651
  Gene Symbol: KDM4B
  Gene Name: lysine (K)-specific demethylase 4B
  Uniprot ID: O94953
  ENSP ID: ENSP00000371178
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQCTCRKDMVKISMDVFVRILQPERYELWKQGKDLTVLDHTRPTALTSPELSSWSASRASLKAKLLRRTPPCVSPHRPSQPGIWCPPGGEAKASAASWLLTTRGHGDTEAGPGLGGDPLHAQSEGQASCVSTSRLRMATQDPCR

SEQ ID NO: 47725 - protein, 1130 aa, Homo sapiens
  Payload ID: 9651
  Gene Symbol: KDM4B
  Gene Name: lysine (K)-specific demethylase 4B
  ENSP ID: ENSP00000440495
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQCTCRKDMVKISMDVFVRILQPERYELWKQGKDLTVLDHTRPTALTSPELSSWSASRASLKAKLLRRQISLKENRHWRKTEEERKPSLERKKEQTKRPGLSSHRKRSQPKKPKPEDPKFPGEGTAGAALLEEAGGSVKEEAGPEVDPEEEEEEPQPLPHGREAEGAEEDGRGKLRPTKAKSERKKKSFGLLPPQLPPPPAHFPSEEALWLPSPLEPPVLGPGPAAMEESPLPAPLNVVPPEVPSEELEAKPRPIIPMLYVVPRPGKAAFNQEHVSCQQAFEHFAQKGPTWKEPVSPMELTGPEDGAASSGAGRMETKARAGEGQAPSTFSKLKMEIKKSRRHPLGRPPTRSPLSVVKQEASSDEEASPFSGEEDVSDPDALRPLLSLQWKNRAASFQAERKFNAAAARTEPYCAICTLFYPYCQALQTEKEAPIASLGEGCPATLPSKSRQKTRPLIPEMCFTSGGENTEPLPANSYIGDDGTSPLIACGKCCLQVHASCYGIRPELVNEGWTCSRCAAHAWTAECCLCNLRGGALQMTTDRRWIHVICAIAVPEARFLNVIERHPVDISAIPEQRWKLKCVYCRKRMKKVSGACIQCSYEHCSTSFHVTCAHAAGVLMEPDDWPYVVSITCLKHKSGGHAVQLLRAVSLGQVVITKNRNGLYYRCRVIGAASQTCYEVNFDDGSYSDNLYPESITSRDCVQLGPPSEGELVELRWTDGNLYKAKFISSVTSHIYQVEFEDGSQLTVKRGDIFTLEEELPKRVRSRLSLSTGAPQEPAFSGEEAKAAKRPRVGTPLATEDSGRSQDYVAFVESLLQVQGRPGAPF

SEQ ID NO: 47726 - protein, 623 aa, Homo sapiens
  Payload ID: 9651
  Gene Symbol: KDM4B
  Gene Name: lysine (K)-specific demethylase 4B
  ENSP ID: ENSP00000467678
  MOD_RES (1)..(1): Any amino acid
XTNFATLRWIDYGKVATQCTCRKDMVKISMDVFVRILQPERYELWKQGKDLTVLDHTRPTALTSPELSSWSASRASLKAKLLRRQISLKENRHWRKTEEERKPSLERKKEQTKRPGLSSHRKRSQPKKPKPEDPKFPGEGTAGAALLEEAGGSVKEEAGPEVDPEEEEEEPQPLPHGREAEGAEEDGRGKLRPTKAKSERKKKSFGLLPPQLPPPPAHFPSEEALWLPSPLEPPVLGPGPAAMEESPLPAPLNVVPPEVPSEELEAKPRPIIPMLYVVPRPGKAAFNQEHVSCQQAFEHFAQKGPTWKEPVSPMELTGPEDGAASSGAGRMETKARAGEGQAPSTFSKLKMEIKKSRRHPLGRPPTRSPLSVVKQEASSDEEASPFSGEEDVSDPDALRPLLSLQWKNRAASFQAERKFNAAAARTEPYCAICTLFYPYCQALQTEKEAPIASLGEGCPATLPSKSRQKTRPLIPEMCFTSGGENTEPLPANSYIGDDGTSPLIACGKCCLQVHASCYGIRPELVNEGWTCSRCAAHAWTAECCLCNLRGGALQMTTDRRWIHVICAIAVPEARFLNVIERHPVDISAIPEQRWKLVRSLGPGGAWPIMAWAAALQGCLLHTL

SEQ ID NO: 47727 - protein, 120 aa, Homo sapiens
  Payload ID: 9651
  Gene Symbol: KDM4B
  Gene Name: lysine (K)-specific demethylase 4B
  ENSP ID: ENSP00000468514
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLER

SEQ ID NO: 47728 - protein, 1130 aa, Homo sapiens; identical to SEQ ID NO: 47725
  Payload ID: 9651
  Gene Symbol: KDM4B
  Gene Name: lysine (K)-specific demethylase 4B
  ENSP ID: ENSP00000480642

SEQ ID NO: 47729 - protein, 1047 aa, Homo sapiens
  Payload ID: 9652
  Gene Symbol: KDM4C
  Gene Name: lysine (K)-specific demethylase 4C
  Uniprot ID: Q9H3R0
  ENSP ID: ENSP00000370707
MEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFVSAGRCHLGTCQVNSLSSPHVSQAQQETYLGFWINSKKSQCNIFLSGTY

SEQ ID NO: 47730 - protein, 1056 aa, Homo sapiens
  Payload ID: 9652
  Gene Symbol: KDM4C
  Gene Name: lysine (K)-specific demethylase 4C
  Uniprot ID: Q9H3R0
  ENSP ID: ENSP00000370710
MEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFSTASDMRFEDTFYGADIIQGERKRQRVLSSRFKNEYVADPVYRTFLKSSFQKKCQKRQ

SEQ ID NO: 47731 - protein, 151 aa, Homo sapiens
  Payload ID: 9652
  Gene Symbol: KDM4C
  Gene Name: lysine (K)-specific demethylase 4C
  ENSP ID: ENSP00000383990
MEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEVHSYLQ

SEQ ID NO: 47732 - protein, 354 aa, Homo sapiens
  Payload ID: 9652
  Gene Symbol: KDM4C
  Gene Name: lysine (K)-specific demethylase 4C
  ENSP ID: ENSP00000400127
PDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIA

SEQ ID NO: 47733 - protein, 373 aa, Homo sapiens
  Payload ID: 9652
  Gene Symbol: KDM4C
  Gene Name: lysine (K)-specific demethylase 4C
  ENSP ID: ENSP00000404756
MEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRRL

SEQ ID NO: 47734 - protein, 743 aa, Homo sapiens
  Payload ID: 9652
  Gene Symbol: KDM4C
  Gene Name: lysine (K)-specific demethylase 4C
  ENSP ID: ENSP00000405739
MVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFSTASDMRFEDTFYGADIIQGERKRQRVLSSRFKNEYVADPVYRTFLKSSFQKKCQKRQ

SEQ ID NO: 47735 - protein, 813 aa, Homo sapiens
  Payload ID: 9652
  Gene Symbol: KDM4C
  Gene Name: lysine (K)-specific demethylase 4C
  Uniprot ID: Q9H3R0
  ENSP ID: ENSP00000445427
MEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLGRLGI

SEQ ID NO: 47736 - protein, 523 aa, Homo sapiens
  Payload ID: 9653
  Gene Symbol: KDM4D
  Gene Name: lysine (K)-specific demethylase 4D
  Uniprot ID: Q6B0I6
  ENSP ID: ENSP00000334181
METMKSKANCAQNPNCNIMIFHPTKEEFNDFDKYIAYMESQGAHRAGLAKIIPPKEWKARETYDNISEILIATPLQQVASGRAGVFTQYHKKKKAMTVGEYRHLANSKKYQTPPHQNFEDLERKYWKNRIYNSPIYGADISGSLFDENTKQWNLGHLGTIQDLLEKECGVVIEGVNTPYLYFGMWKTTFAWHTEDMDLYSINYLHLGEPKTWYVVPPEHGQRLERLARELFPGSSRGCGAFLRHKVALISPTVLKENGIPFNRITQEAGEFMVTFPYGYHAGFNHGFNCAEAINFATPRWIDYGKMASQCSCGEARVTFSMDAFVRILQPERYDLWKRGQDRAVVDHMEPRVPASQELSTQKEVQLPRRAALGLRQLPSHWARHSPWPMAARSGTRCHTLVCSSLPRRSAVSGTATQPRAAAVHSSKKPSSTPSSTPGPSAQIIHPSNGRRGRGRPPQKLRAQELTLQTPAKRPLLAGTTCTASGPEPEPLPEDGALMDKPVPLSPGLQHPVKASGCSWAPVP

SEQ ID NO: 47737 - protein, 523 aa, Homo sapiens; identical to SEQ ID NO: 47736
  Payload ID: 9653
  Gene Symbol: KDM4D
  Gene Name: lysine (K)-specific demethylase 4D
  Uniprot ID: Q6B0I6
  ENSP ID: ENSP00000460897

SEQ ID NO: 47738 - protein, 523 aa, Homo sapiens; identical to SEQ ID NO: 47736
  Payload ID: 9653
  Gene Symbol: KDM4D
  Gene Name: lysine (K)-specific demethylase 4D
  Uniprot ID: Q6B0I6
  ENSP ID: ENSP00000482224

SEQ ID NO: 47739 - protein, 506 aa, Homo sapiens
  Payload ID: 9654
  Gene Symbol: KDM4E
  Gene Name: lysine (K)-specific demethylase 4E
  Uniprot ID: B2RXH2
  ENSP ID: ENSP00000397239
MKSVHSSPQNTSHTIMTFYPTMEEFADFNTYVAYMESQGAHQAGLAKVIPPKEWKARQMYDDIEDILIATPLQQVTSGQGGVFTQYHKKKKAMRVGQYRRLANSKKYQTPPHQNFADLEQRYWKSHPGNPPIYGADISGSLFEESTKQWNLGHLGTILDLLEQECGVVIEGVNTPYLYFGMWKTTFAWHTEDMDLYSINYLHFGEPKTWYVVPPEHGQHLERLARELFPDISRGCEAFLRHKVALISPTVLKENGIPFNCMTQEAGEFMVTFPYGYHAGFNHGFNCAEAINFATPRWIDYGKMASQCSCGESTVTFSMDPFVRIVQPESYELWKHRQDLAIVEHTEPRVAESQELSNWRDDIVLRRAALGLRLLPNLTAQCPTQPVSSGHCYNPKGCGTDAVPGSAFQSSAYHTQTQSLTLGMSARVLLPSTGSWGSGRGRGRGQGQGRGCSRGRGHGCCTRELGTEEPTVQPASKRRLLMGTRSRAQGHRPQLPLANDLMTNLSL

SEQ ID NO: 47740 - protein, 1722 aa, Homo sapiens
  Payload ID: 9655
  Gene Symbol: KDM5A
  Gene Name: lysine (K)-specific demethylase 5A
  ENSP ID: ENSP00000372265
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQVFFGKGSSTPRKQPRKSPLVPRSLEPPVLELSPGAKAQLEELMMVGDLLEVSLDETQHIWRILQATHPPSEDRFLHIMEDDSMEEKPLKVKGKDSSEKKRKRKLEKVEQLFGEGKQKSKELKKMDKPRKKKLKLGADKSKELNKLAKKLAKEEERKKKKEKAAAAKVELVKESTEKKREKKVLDIPSKYDWSGAEESDDENAVCAAQNCQRPCKDKGVVFVTKKRRIKNISFKSGLCDCFSKKVDWVQCDGGCDEWFHQVCVGVSPEMAENEDYICINCAKKQGPVSPGPAPPPSFIMSYKLPMEDLKETS

SEQ ID NO: 47741 - protein, 1690 aa, Homo sapiens
  Payload ID: 9655
  Gene Symbol: KDM5A
  Gene Name: lysine (K)-specific demethylase 5A
  Uniprot ID: P29375
  ENSP ID: ENSP00000382688
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQGSSTPRKQPRKSPLVPRSLEPPVLELSPGAKAQLEELMMVGDLLEVSLDETQHIWRILQATHPPSEDRFLHIMEDDSMEEKPLKVKGKDSSEKKRKRKLEKVEQLFGEGKQKSKELKKMDKPRKKKLKLGADKSKELNKLAKKLAKEEERKKKKEKAAAAKVELVKESTEKKREKKVLDIPSKYDWSGAEESDDENAVCAAQNCQRPCKDKVDWVQCDGGCDEWFHQVCVGVSPEMAENEDYICINCAKKQGPVSPGPAPPPSFIMSYKLPMEDLKETS

SEQ ID NO: 47742 - protein, 122 aa, Homo sapiens
  Payload ID: 9655
  Gene Symbol: KDM5A
  Gene Name: lysine (K)-specific demethylase 5A
  ENSP ID: ENSP00000438203
MLKSLDVGNSRSTILESQLLQITRFAYKVNYNLTFEDWQPPFACEVKSFRFTPRVQRLNELEAMTRVRLDFLDQLAKFWELQGSTLKIPVVERKILDLYALSKIVASKGGFEMVTKEKKWSK

SEQ ID NO: 47743 - protein, 715 aa, Homo sapiens
  Payload ID: 9655
  Gene Symbol: KDM5A
  Gene Name: lysine (K)-specific demethylase 5A
  ENSP ID: ENSP00000440622
MAGVGPGGYAAEFVPPPECPVFEPSWEEFTDPLSFIGRIRPLAEKTGICKIRPPKEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKEL

SEQ ID NO: 47744 - protein, 126 aa, Homo sapiens
  Payload ID: 9655
  Gene Symbol: KDM5A
  Gene Name: lysine (K)-specific demethylase 5A
  ENSP ID: ENSP00000443854
MAGVGPGGYAAEFVPPPECPVFEPSWEEFTDPLSFIGRIRPLAEKTGICKIRPPKDWQPPFACEVKSFRFTPRVQRLNELEIVASKGGFEMVTKEKKWSKVGSRLGYLPGKGTGSLLKSHYERILY

SEQ ID NO: 47745 - protein, 131 aa, Homo sapiens
  Payload ID: 9655
  Gene Symbol: KDM5A
  Gene Name: lysine (K)-specific demethylase 5A
  ENSP ID: ENSP00000444251
MAGVGPGGYAAEFVPPPECPVFEPSWEEFTDPLSFIGRIRPLAEKTGICKIRPPKFWQISSVSKDWQPPFACEVKSFRFTPRVQRLNELEAMTRVRLDFLDQLAKFWELQGSTLKIPVVERKILDLYALSK

SEQ ID NO: 47746 - protein, 1275 aa, Homo sapiens
  Payload ID: 9656
  Gene Symbol: KDM5B
  Gene Name: lysine (K)-specific demethylase 5B
  ENSP ID: ENSP00000235790
MGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTP

SEQ ID NO: 47747 - protein, 1580 aa, Homo sapiens
  Payload ID: 9656
  Gene Symbol: KDM5B
  Gene Name: lysine (K)-specific demethylase 5B
  Uniprot ID: Q9UGL1
  ENSP ID: ENSP00000356233
MEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAERQSLAVLPRLECSGAILAHCNLRLLDSSNSSASASQAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 47748 - protein, 1544 aa, Homo sapiens
  Payload ID: 9656
  Gene Symbol: KDM5B
  Gene Name: lysine (K)-specific demethylase 5B
  Uniprot ID: Q9UGL1
  ENSP ID: ENSP00000356234
MEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 47749 - protein, 77 aa, Homo sapiens
  Payload ID: 9656
  Gene Symbol: KDM5B
  Gene Name: lysine (K)-specific demethylase 5B
  ENSP ID: ENSP00000473481
ICKVRPPPDWQPPFACDVDKLHFTPRIQRLNELESRSVTQGGVQQHYPGSLQPLPPGFKSFSCLSLPSSWDYRPKLV

SEQ ID NO: 47750 - protein, 74 aa, Homo sapiens
  Payload ID: 9657
  Gene Symbol: KDM5C
  Gene Name: lysine (K)-specific demethylase 5C
  ENSP ID: ENSP00000344004
MEPGSDDFLPPPECPVFEPSWAEFRDPLGYIAKIRPIAEKSGICKIRPPASGIPALTPTPWGFLPCLFLYQAGV

SEQ ID NO: 47751 - protein, 1557 aa, Homo sapiens
  Payload ID: 9657
  Gene Symbol: KDM5C
  Gene Name: lysine (K)-specific demethylase 5C
  Uniprot ID: P41229
  ENSP ID: ENSP00000364528
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 47752 - protein, 1516 aa, Homo sapiens
  Payload ID: 9657
  Gene Symbol: KDM5C
  Gene Name: lysine (K)-specific demethylase 5C
  Uniprot ID: P41229
  ENSP ID: ENSP00000364532
MEPGSDDFLPPPECPVFEPSWAEFRDPLGYIAKIRPIAEKSGICKIRPPADWQPPFAVEVDNFRFTPRIQRLNELEIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 47753 - protein, 1560 aa, Homo sapiens
  Payload ID: 9657
  Gene Symbol: KDM5C
  Gene Name: lysine (K)-specific demethylase 5C
  Uniprot ID: P41229
  ENSP ID: ENSP00000364550
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 47754 - protein, 1559 aa, Homo sapiens
  Payload ID: 9657
  Gene Symbol: KDM5C
  Gene Name: lysine (K)-specific demethylase 5C
  Uniprot ID: P41229
  ENSP ID: ENSP00000385394
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 47755 - protein, 99 aa, Homo sapiens
  Payload ID: 9657
  Gene Symbol: KDM5C
  Gene Name: lysine (K)-specific demethylase 5C
  ENSP ID: ENSP00000407277
MEPGSDDFLPPPECPVFEPSWAEFRDPLGYIAKIRPIAEKSGICKIRPPADWQPPFAVEVDNFRFTPRIQRLNELEFQLLRRLRQEDHLSPGGQVYSQP

SEQ ID NO: 47756 - protein, 53 aa, Homo sapiens
  Payload ID: 9657
  Gene Symbol: KDM5C
  Gene Name: lysine (K)-specific demethylase 5C
  ENSP ID: ENSP00000409757
MEPGSDDFLPPPECPVFEPSWAEFRDPLGYIAKIRPIAEKSGICKIRPPAAGV

SEQ ID NO: 47757 - protein, 1379 aa, Homo sapiens
  Payload ID: 9657
  Gene Symbol: KDM5C
  Gene Name: lysine (K)-specific demethylase 5C
  Uniprot ID: P41229
  ENSP ID: ENSP00000445176
MEPGSDDFLPPPECPVFEPSWAEFRDPLGYIAKIRPIAEKSGICKIRPPAIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSDLELLSSLLPQLTGPVLELPEATRAPLEELMMEGDLLEVTLDENHSIPESLDFCILTPRYCSDLSSWGPAPGVFPPW

SEQ ID NO: 47758 - protein, 1539 aa, Homo sapiens
  Payload ID: 9658
  Gene Symbol: KDM5D
  Gene Name: lysine (K)-specific demethylase 5D
  Uniprot ID: Q9BY66
  ENSP ID: ENSP00000322408
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 47759 - protein, 1482 aa, Homo sapiens
  Payload ID: 9658
  Gene Symbol: KDM5D
  Gene Name: lysine (K)-specific demethylase 5D
  Uniprot ID: Q9BY66
  ENSP ID: ENSP00000372256
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 47760 - protein, 293 aa, Homo sapiens
  Payload ID: 9658
  Gene Symbol: KDM5D
  Gene Name: lysine (K)-specific demethylase 5D
  ENSP ID: ENSP00000389433
LPNIQALKEALTKAQAWIADVDEIQNGDHYPCLDDLEGLVAVGRDLPVGLEELRQLELQVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACD

SEQ ID NO: 47761 - protein, 1476 aa, Homo sapiens
  Payload ID: 9658
  Gene Symbol: KDM5D
  Gene Name: lysine (K)-specific demethylase 5D
  ENSP ID: ENSP00000398543
MEPGCDEFLPPPECPVFEPSWAEFQDPLGYIAKIRPIAEKSGICKIRPPADWQPPFAVEVDNFRFTPRVQRLNELEIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSG

SEQ ID NO: 47762 - protein, 425 aa, Homo sapiens
  Payload ID: 9658
  Gene Symbol: KDM5D
  Gene Name: lysine (K)-specific demethylase 5D
  ENSP ID: ENSP00000416377
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMP

SEQ ID NO: 47763 - protein, 1570 aa, Homo sapiens
  Payload ID: 9658
  Gene Symbol: KDM5D
  Gene Name: lysine (K)-specific demethylase 5D
  Uniprot ID: Q9BY66
  ENSP ID: ENSP00000444293
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKRQSLTVLTRLISSFWAQAVLPPWPPKVLGLQEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 47764 - protein, 1401 aa, Homo sapiens
  Payload ID: 9659
  Gene Symbol: KDM6A
  Gene Name: lysine (K)-specific demethylase 6A
  Uniprot ID: O15550
  ENSP ID: ENSP00000367203
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 47765 - protein, 1384 aa, Homo sapiens
  Payload ID: 9659
  Gene Symbol: KDM6A
  Gene Name: lysine (K)-specific demethylase 6A
  ENSP ID: ENSP00000372355
MAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQACKPHHPNTEPVLGLSQTPISQQSLPLHMIPSSQVDDLSSPAKRKRTSSPTKNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 47766 - protein, 1044 aa, Homo sapiens
  Payload ID: 9659
  Gene Symbol: KDM6A
  Gene Name: lysine (K)-specific demethylase 6A
  ENSP ID: ENSP00000398929
  MOD_RES (1)..(1): Any amino acid
XNKTKLLPSIEEAWSLPIPAELTSRQGAMNTAQQACKPHHPNTEPVLGLSQTPISQQSLPLHMIPSSQVDDLSSPAKRKRTSSPTKNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 47767 - protein, 224 aa, Homo sapiens
  Payload ID: 9659
  Gene Symbol: KDM6A
  Gene Name: lysine (K)-specific demethylase 6A
  ENSP ID: ENSP00000399980
  MOD_RES (1)..(1): Any amino acid
XLQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQMRPTGVAQVRSTGIPNGPTADSSLPTNSVSGQQPQLALTRVPSVSQPGVRPACPGQPLANGPFSAGHVPCSTSRTLGSTDTILIG

SEQ ID NO: 47768 - protein, 999 aa, Homo sapiens
  Payload ID: 9659
  Gene Symbol: KDM6A
  Gene Name: lysine (K)-specific demethylase 6A
  ENSP ID: ENSP00000405910
  MOD_RES (1)..(1): Any amino acid
XGTLYESCNQPQDAIKCYLNATRSKSCSNTSALAARIKYLQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 47769 - protein, 161 aa, Homo sapiens
  Payload ID: 9659
  Gene Symbol: KDM6A
  Gene Name: lysine (K)-specific demethylase 6A
  ENSP ID: ENSP00000408230
  MOD_RES (1)..(1): Any amino acid
XARNIKVSDPKLFEMIKIFSLSPNFRAEKCLRDHLVQPLRSNGEPEPLRFTGEYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 47770 - protein, 1332 aa, Homo sapiens
  Payload ID: 9659
  Gene Symbol: KDM6A
  Gene Name: lysine (K)-specific demethylase 6A
  ENSP ID: ENSP00000437405
MAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 47771 - protein, 1269 aa, Homo sapiens
  Payload ID: 9659
  Gene Symbol: KDM6A
  Gene Name: lysine (K)-specific demethylase 6A
  ENSP ID: ENSP00000443078
MAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQACKPHHPNTEPVLGLSQTPISQQSLPLHMIPSSQVDDLSSPAKRKRTSSPTKNTSDNWSGGHAVSHPPVQQQAHSWCLTPQKLQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVLSSKNSEAMSDIEGSSHCCRKRDYMAWADKRRTSSLL

SEQ ID NO: 47772 - protein, 224 aa, Homo sapiens
  Payload ID: 9659
  Gene Symbol: KDM6A
  Gene Name: lysine (K)-specific demethylase 6A
  ENSP ID: ENSP00000478793
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQVGCITL

SEQ ID NO: 47773 - protein, 1429 aa, Homo sapiens
  Payload ID: 9659
  Gene Symbol: KDM6A
  Gene Name: lysine (K)-specific demethylase 6A
  ENSP ID: ENSP00000483595
MAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQACKPHHPNTEPVLGLSQTPISQQSLPLHMIPSSQVDDLSSPAKRKRTSSPTKNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 47774 - protein, 1682 aa, Homo sapiens
  Payload ID: 9660
  Gene Symbol: KDM6B
  Gene Name: lysine (K)-specific demethylase 6B
  Uniprot ID: O15054
  ENSP ID: ENSP00000254846
MHRAVDPPGARAAREAFALGGLSCAGAWSSCPPHPPPRSAWLPGGRCSASIGQPPLPAPLPPSHGSSSGHPSKPYYAPGAPTPRPLHGKLESLHGCVQALLREPAQPGLWEQLGQLYESEHDSEEATRCYHSALRYGGSFAELGPRIGRLQQAQLWNFHTGSCQHRAKVLPPLEQVWNLLHLEHKRNYGAKRGGPPVKRAAEPPVVQPVPPAALSGPSGEEGLSPGGKRRRGCNSEQTGLPPGLPLPPPPLPPPPPPPPPPPPPLPGLATSPPFQLTKPGLWSTLHGDAWGPERKGSAPPERQEQRHSLPHPYPYPAPAYTAHPPGHRLVPAAPPGPGPRPPGAESHGCLPATRPPGSDLRESRVQRSRMDSSVSPAATTACVPYAPSRPPGLPGTTTSSSSSSSSNTGLRGVEPNPGIPGADHYQTPALEVSHHGRLGPSAHSSRKPFLGAPAATPHLSLPPGPSSPPPPPCPRLLRPPPPPAWLKGPACRAAREDGEILEELFFGTEGPPRPAPPPLPHREGFLGPPASRFSVGTQDSHTPPTPPTPTTSSSNSNSGSHSSSPAGPVSFPPPPYLARSIDPLPRPPSPAQNPQDPPLVPLTLALPPAPPSSCHQNTSGSFRRPESPRPRVSFPKTPEVGPGPPPGPLSKAPQPVPPGVGELPARGPRLFDFPPTPLEDQFEEPAEFKILPDGLANIMKMLDESIRKEEEQQQHEAGVAPQPPLKEPFASLQSPFPTDTAPTTTAPAVAVTTTTTTTTTTTATQEEEKKPPPALPPPPPLAKFPPPSQPQPPPPPPPSPASLLKSLASVLEGQKYCYRGTGAAVSTRPGPLPTTQYSPGPPSGATALPPTSAAPSAQGSPQPSASSSSQFSTSGGPWARERRAGEEPVPGPMTPTQPPPPLSLPPARSESEVLEEISRACETLVERVGRSATDPADPVDTAEPADSGTERLLPPAQAKEEAGGVAAVSGSCKRRQKEHQKEHRRHRRACKDSVGRRPREGRAKAKAKVPKEKSRRVLGNLDLQSEEIQGREKSRPDLGGASKAKPPTAPAPPSAPAPSAQPTPPSASVPGKKAREEAPGPPGVSRADMLKLRSLSEGPPKELKIRLIKVESGDKETFIASEVEERRLRMADLTISHCAADVVRASRNAKVKGKFRESYLSPAQSVKPKINTEEKLPREKLNPPTPSIYLESKRDAFSPVLLQFCTDPRNPITVIRGLAGSLRLNLGLFSTKTLVEASGEHTVEVRTQVQQPSDENWDLTGTRQIWPCESSRSHTTIAKYAQYQASSFQESLQEEKESEDEESEEPDSTTGTPPSSAPDPKNHHIIKFGTNIDLSDAKRWKPQLQELLKLPAFMRVTSTGNMLSHVGHTILGMNTVQLYMKVPGSRTPGHQENNNFCSVNINIGPGDCEWFAVHEHYWETISAFCDRHGVDYLTGSWWPILDDLYASNIPVYRFVQRPGDLVWINAGTVHWVQATGWCNNIAWNVGPLTAYQYQLALERYEWNEVKNVKSIVPMIHVSWNVARTVKISDPDLFKMIKFCLLQSMKHCQVQRESLVRAGKKIAYQGRVKDEPAYYCNECDVEVFNILFVTSENGSRNTYLVHCEGCARRRSAGLQGVVVLEQYRTEELAQAYDAFTLVRARRARGQRRRALGQAAGTGFGSPAAPFPEPPPAFSPQAPASTSR

SEQ ID NO: 47775 - protein, 1643 aa, Homo sapiens
  Payload ID: 9660
  Gene Symbol: KDM6B
  Gene Name: lysine (K)-specific demethylase 6B
  Uniprot ID: O15054
  ENSP ID: ENSP00000412513
MHRAVDPPGARAAREAFALGGLSCAGAWSSCPPHPPPRSAWLPGGRCSASIGQPPLPAPLPPSHGSSSGHPSKPYYAPGAPTPRPLHGKLESLHGCVQALLREPAQPGLWEQLGQLYESEHDSEEATRCYHSALRYGGSFAELGPRIGRLQQAQLWNFHTGSCQHRAKVLPPLEQVWNLLHLEHKRNYGAKRGGPPVKRAAEPPVVQPVPPAALSGPSGEEGLSPGGKRRRGCNSEQTGLPPGLPLPPPPLPPPPPPPPPPPPPLPGLATSPPFQLTKPGLWSTLHGDAWGPERKGSAPPERQEQRHSLPHPYPYPAPAYTAHPPGHRLVPAAPPGPGPRPPGAESHGCLPATRPPGSDLRESRVQRSRMDSSVSPAATTACVPYAPSRPPGLPGTTTSSSSSSSSNTGLRGVEPNPGIPGADHYQTPALEVSHHGRLGPSAHSSRKPFLGAPAATPHLSLPPGPSSPPPPPCPRLLRPPPPPAWLKGPACRAAREDGEILEELFFGTEGPPRPAPPPLPHREGFLGPPASRFSVGTQDSHTPPTPPTPTTSSSNSNSGSHSSSPAGPVSFPPPPYLARSIDPLPRPPSPAQNPQDPPLVPLTLALPPAPPSSCHQNTSGSFRRPESPRPRVSFPKTPEVGPGPPPGPLSKAPQPVPPGVGELPARGPRLFDFPPTPLEDQFEEPAEFKILPDGLANIMKMLDESIRKEEEQQQHEAGVAPQPPLKEPFASLQSPFPTDTAPTTTAPAVAVTTTTTTTTTTTATQEEEKKPPPALPPPPPLAKFPPPSQPQPPPPPPPSPASLLKSLASVLEGQKYCYRGTGAAVSTRPGPLPTTQYSPGPPSGATALPPTSAAPSAQGSPQPSASSSSQFSTSGGPWARERRAGEEPVPGPMTPTQPPPPLSLPPARSESEVLEEISRACETLVERVGRSATDPADPVDTAEPADSGTERLLPPAQAKEEAGGVAAVSGSCKRRQKEHQKEHRRHRRACKDSVGRRPREGRAKAKAKVPKEKSRRVLGNLDLQSEEIQGREKSRPDLGGASKAKPPTAPAPPSAPAPSAQPTPPSASVPGKKAREEAPGPPGVSRADMLKLRSLSEGPPKELKIRLIKVESGDKETFIASEVEERRLRMADLTISHCAADVVRASRNAKVKGKFRESYLSPAQSVKPKINTEEKLPREKLNPPTPSIYLESKRDAFSPVLLQFCTDPRNPITVIRGLAGSLRLNLGLFSTKTLVEASGEHTVEVRTQVQQPSDENWDLTGTRQIWPCESSRSHTTIAKYAQYQASSFQESLQEEKESEDEESEEPDSTTGTPPSSAPDPKNHHIIKFGTNIDLSDAKRWKPQLQELLKLPAFMRVTSTGNMLSHVGHTILGMNTVQLYMKVPGSRTPGHQENNNFCSVNINIGPGDCEWFAVHEHYWETISAFCDRHGVDYLTGSWWPILDDLYASNIPVYRFVQRPGDLVWINAGTVHWVQATGWCNNIAWNVGPLTAYQYQLALERYEWNEVKNVKSIVPMIHVSWNVARTVKISDPDLFKMIKFCLLQSMKHCQVQRESLVRAGKKIAYQGRVKDEPAYYCNECDVEVFNILFVTSENGSRNTYLVHCEGCARRRSAGLQGVVVLEQYRTEELAQAYDAFTLAPASTSR

SEQ ID NO: 47776 - protein, 361 aa, Homo sapiens
  Payload ID: 9660
  Gene Symbol: KDM6B
  Gene Name: lysine (K)-specific demethylase 6B
  ENSP ID: ENSP00000458445
MHRAVDPPGARAAREAFALGGLSCAGAWSSCPPHPPPRSAWLPGGRCSASIGQPPLPAPLPPSHGSSSGHPSKPYYAPGAPTPRPLHGKLESLHGCVQALLREPAQPGLWEQLGQLYESEHDSEEATRCYHSALRYGGSFAELGPRIGRLQQAQLWNFHTGSCQHRAKVLPPLEQVWNLLHLEHKRNYGAKRGGPPVKRAAEPPVVQPVPPAALSGPSGEEGLSPGGKRRRGCNSEQEQRHSLPHPYPYPAPAYTAHPPGHRLVPAAPPGPGPRPPGAESHGCLPATRPPGSDLRESRVQRSRMDSSVSPAATTACVPYAPSRPPGLPGTTTSSSSSSSSNTGLRGVEPNPGIPGADHYQT

SEQ ID NO: 47777 - protein, 941 aa, Homo sapiens
  Payload ID: 9661
  Gene Symbol: KDM7A
  Gene Name: lysine (K)-specific demethylase 7A
  Uniprot ID: Q6ZMT4
  ENSP ID: ENSP00000380692
MAGAAAAVAAGAAAGAAAAAVSVAAPGRASAPPPPPPVYCVCRQPYDVNRFMIECDICKDWFHGSCVGVEEHHAVDIDLYHCPNCAVLHGSSLMKKRRNWHRHDYTEIDDGSKPVQAGTRTFIKELRSRVFPSADEIIIKMHGSQLTQRYLEKHGFDVPIMVPKLDDLGLRLPSPTFSVMDVERYVGGDKVIDVIDVARQADSKMTLHNYVKYFMNPNRPKVLNVISLEFSDTKMSELVEVPDIAKKLSWVENYWPDDSVFPKPFVQKYCLMGVQDSYTDFHIDFGGTSVWYHVLWGEKIFYLIKPTDENLARYESWSSSVTQSEVFFGDKVDKCYKCVVKQGHTLFVPTGWIHAVLTSQDCMAFGGNFLHNLNIGMQLRCYEMEKRLKTPDLFKFPFFEAICWFVAKNLLETLKELREDGFQPQTYLVQGVKALHTALKLWMKKELVSEHAFEIPDNVRPGHLIKELSKVIRAIEEENGKPVKSQGIPIVCPVSRSSNEATSPYHSRRKMRKLRDHNVRTPSNLDILELHTREVLKRLEMCPWEEDILSSKLNGKFNKHLQPSSTVPEWRAKDNDLRLLLTNGRIIKDERQPFADQSLYTADSENEEDKRRTKKAKMKIEESSGVEGVEHEESQKPLNGFFTRVKSELRSRSSGYSDISESEDSGPECTALKSIFTTEESESSGDEKKQEITSNFKEESNVMRNFLQKSQKPSRSEIPIKRECPTSTSTEEEAIQGMLSMAGLHYSTCLQRQIQSTDCSGERNSLQDPSSCHGSNHEVRQLYRYDKPVECGYHVKTEDPDLRTSSWIKQFDTSRFHPQDLSRSQKCIRKEGSSEISQRVQSRNYVDSSGSSLQNGKYMQNSNLTSGACQISNGSLSPERPVGETSFSVPLHPTKRPASNPPPISNQATKGKRPKKGMATAKQRLGKILKLNRNGHARFFV

SEQ ID NO: 47778 - protein, 404 aa, Homo sapiens
  Payload ID: 9661
  Gene Symbol: KDM7A
  Gene Name: lysine (K)-specific demethylase 7A
  ENSP ID: ENSP00000420143
  MOD_RES (1)..(1): Any amino acid
XAKNLLETLKELREDGFQPQTYLVQGVKALHTALKLWMKKELVSEHAFEIPDNVRPGHLIKELSKVIRAIEEENGKPVKSQGIPIVCPVSRSSNEATSPYHSRRKMRKLRDHNVRTPSNLDILELHTREVLKRLEMCPWEEDILSSKLNGKFNKHLQPSSTVPEWRAKDNDLRLLLTNGRIIKDERQPFADQSLYTADSENEEDKRRTKKAKMKIEESSGVEGVEHEESQKPLNGFFTRVKSELRSRSSGYSDISESEDSGPECTALKSIFTTEESESSGDEKKQEITSNFKEESNVMRNFLQKSQKPSRSEIPIKRECPTSTSTEEEAIQGMLSMAGLHYSTCLQRQIQSTDCSGERNSLQDPSSCHGSNHEVRQLYRYDKPVECETRSHLCCPDWSPTPELK

SEQ ID NO: 47779 - protein, 416 aa, Homo sapiens
  Payload ID: 9662
  Gene Symbol: KDM8
  Gene Name: lysine (K)-specific demethylase 8
  Uniprot ID: Q8N371
  ENSP ID: ENSP00000286096
MAGDTHCPAEPLAREGTLWEALRALLPHSKEDLKLDLGEKVERSVVTLLQRATELFYEGRRDECLQSSEVILDYSWEKLNTGTWQDVDKDWRRVYAIGCLLKALCLCQAPEDANTVAAALRVCDMGLLMGAAILGDILLKVAAILQTHLPGKRPARGSLPEQPCTKKARADHGLIPDVKLEKTVPRLHRPSLQHFREQFLVPGRPVILKGVADHWPCMQKWSLEYIQEIAGCRTVPVEVGSRYTDEEWSQTLMTVNEFISKYIVNEPRDVGYLAQHQLFDQIPELKQDISIPDYCSLGDGEEEEITINAWFGPQGTISPLHQDPQQNFLVQVMGRKYIRLYSPQESGALYPHDTHLLHNTSQVDVENPDLEKFPKFAKAPFLSCILSPGEILFIPVKYWHYVRALDLSFSVSFWWS

SEQ ID NO: 47780 - protein, 454 aa, Homo sapiens
  Payload ID: 9662
  Gene Symbol: KDM8
  Gene Name: lysine (K)-specific demethylase 8
  Uniprot ID: Q8N371
  ENSP ID: ENSP00000398410
MSREKCSPGEGAEEGRGSEASGLKASAGHGTEPAGGGPMAGDTHCPAEPLAREGTLWEALRALLPHSKEDLKLDLGEKVERSVVTLLQRATELFYEGRRDECLQSSEVILDYSWEKLNTGTWQDVDKDWRRVYAIGCLLKALCLCQAPEDANTVAAALRVCDMGLLMGAAILGDILLKVAAILQTHLPGKRPARGSLPEQPCTKKARADHGLIPDVKLEKTVPRLHRPSLQHFREQFLVPGRPVILKGVADHWPCMQKWSLEYIQEIAGCRTVPVEVGSRYTDEEWSQTLMTVNEFISKYIVNEPRDVGYLAQHQLFDQIPELKQDISIPDYCSLGDGEEEEITINAWFGPQGTISPLHQDPQQNFLVQVMGRKYIRLYSPQESGALYPHDTHLLHNTSQVDVENPDLEKFPKFAKAPFLSCILSPGEILFIPVKYWHYVRALDLSFSVSFWWS

SEQ ID NO: 47781 - protein, 120 aa, Homo sapiens
  Payload ID: 9662
  Gene Symbol: KDM8
  Gene Name: lysine (K)-specific demethylase 8
  ENSP ID: ENSP00000454215
MAGDTHCPAEPLAREGTLWEALRALLPHSKEDLKLDLGEKVERSVVTLLQRATELFYEGRRDECLQSSEVILDYSWEKLNTGTWQDVDKDWRRVYAIGCLLKALCLCQAPEDANTVAAAL

SEQ ID NO: 47782 - protein, 90 aa, Homo sapiens
  Payload ID: 9662
  Gene Symbol: KDM8
  Gene Name: lysine (K)-specific demethylase 8
  ENSP ID: ENSP00000455463
  MOD_RES (1)..(1): Any amino acid
XVNEFISKYIVNEPRDVGYLAQHQLFDQIPELKQDISIPDYCSLGDGEEEEITINAWLTWRIPTWKSSPSLPRPHSCPASCLLERSCSSR

SEQ ID NO: 47783 - protein, 163 aa, Homo sapiens
  Payload ID: 9662
  Gene Symbol: KDM8
  Gene Name: lysine (K)-specific demethylase 8
  ENSP ID: ENSP00000456107
MAGDTHCPAEPLAREGTLWEALRALLPHSKEDLKLDLGEKVERSVVTLLQRATELFYEGRRDECLQSSEVILDYSWEKLNTGTWQDVDKDWRRVYAIGCLLKALCLCQAPEDANTVAAALRVCDMGLLMGAAILGDILLKVAAILQTHLPGKRPARGSLPEQP

SEQ ID NO: 47784 - protein, 220 aa, Homo sapiens
  Payload ID: 9662
  Gene Symbol: KDM8
  Gene Name: lysine (K)-specific demethylase 8
  Uniprot ID: Q8N371
  ENSP ID: ENSP00000456901
MAGDTHCPAEPLAREGTLWEALRALLPHSKEDLKLDLGEKVERSVVTLLQRATELFYEGRRDECLQSSEVILDYSWEKLNTGTWQDVDKDWRRVYAIGCLLKALCLCQAPEDANTVAAALRVCDMGLLMGAAILGDILLKVAAILQTHLPGKRPARGSLPEQPCTKVDVENPDLEKFPKFAKAPFLSCILSPGEILFIPVKYWHYVRALDLSFSVSFWWS

SEQ ID NO: 47785 - protein, 3969 aa, Homo sapiens
  Payload ID: 9663
  Gene Symbol: KMT2A
  Gene Name: lysine (K)-specific methyltransferase 2A
  Uniprot ID: Q03164
  ENSP ID: ENSP00000374157
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 47786 - protein, 366 aa, Homo sapiens
  Payload ID: 9663
  Gene Symbol: KMT2A
  Gene Name: lysine (K)-specific methyltransferase 2A
  ENSP ID: ENSP00000376612
DPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNS

SEQ ID NO: 47787 - protein, 1439 aa, Homo sapiens
  Payload ID: 9663
  Gene Symbol: KMT2A
  Gene Name: lysine (K)-specific methyltransferase 2A
  ENSP ID: ENSP00000432391
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGELTTQIPCSWRTKGHIHDKKTEPFRLLAWSWCLNDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFK

SEQ ID NO: 47788 - protein, 160 aa, Homo sapiens
  Payload ID: 9663
  Gene Symbol: KMT2A
  Gene Name: lysine (K)-specific methyltransferase 2A
  ENSP ID: ENSP00000432652
ASSSSASSSSSSSSSASSGPALLRVGPGFDAALQVSAAIGTNLRRFRAVFGESGGGGGSGELTTQIPCSWRTKGHIHDKKTEPFRLLAWSWCLNDEQFLGFGSDEEVRVRSPTRSPSGSMLAQADKLPMTDKRVASLLKKAKAQLCKIEKSKSLKQTDQP

SEQ ID NO: 47789 - protein, 87 aa, Homo sapiens
  Payload ID: 9663
  Gene Symbol: KMT2A
  Gene Name: lysine (K)-specific methyltransferase 2A
  ENSP ID: ENSP00000434618
AAAASAASSSSASSSSSSSSSASSGPALLRVGPGFDAALQVSAAIGTNLRRFRAVFGESGGGGGSGEVPQLKRDEETLETVLRRLKR

SEQ ID NO: 47790 - protein, 87 aa, Homo sapiens; identical to SEQ ID NO: 47789
  Payload ID: 9663
  Gene Symbol: KMT2A
  Gene Name: lysine (K)-specific methyltransferase 2A
  ENSP ID: ENSP00000436564

SEQ ID NO: 47791 - protein, 268 aa, Homo sapiens
  Payload ID: 9663
  Gene Symbol: KMT2A
  Gene Name: lysine (K)-specific methyltransferase 2A
  ENSP ID: ENSP00000436700
ASSSSASSSSSSSSSASSGPALLRVGPGFDAALQVSAAIGTNLRRFRAVFGESGGGGGSGEDEQFLGFGSDEEVRVRSPTRSPSGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCK

SEQ ID NO: 47792 - protein, 3972 aa, Homo sapiens
  Payload ID: 9663
  Gene Symbol: KMT2A
  Gene Name: lysine (K)-specific methyltransferase 2A
  Uniprot ID: Q03164
  ENSP ID: ENSP00000436786
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSGTEDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 47793 - protein, 2715 aa, Homo sapiens
  Payload ID: 9664
  Gene Symbol: KMT2B
  Gene Name: lysine (K)-specific methyltransferase 2B
  Uniprot ID: Q9UMN6
  ENSP ID: ENSP00000398837
MAAAAGGGSCPGPGSARGRFPGRPRGAGGGGGRGGRGNGAERVRVALRRGGGATGPGGAEPGEDTALLRLLGLRRGLRRLRRLWAGPRVQRGRGRGRGRGWGPSRGCVPEEESSDGESDEEEFQGFHSDEDVAPSSLRSALRSQRGRAPRGRGRKHKTTPLPPPRLADVAPTPPKTPARKRGEEGTERMVQALTELLRRAQAPQAPRSRACEPSTPRRSRGRPPGRPAGPCRRKQQAVVVAEAAVTIPKPEPPPPVVPVKHQTGSWKCKEGPGPGPGTPRRGGQSSRGGRGGRGRGRGGGLPFVIKFVSRAKKVKMGQLSLGLESGQGQGQHEESWQDVPQRRVGSGQGGSPCWKKQEQKLDDEEEEKKEEEEKDKEGEEKEERAVAEEMMPAAEKEEAKLPPPPLTPPAPSPPPPLPPPSTSPPPPLCPPPPPPVSPPPLPSPPPPPAQEEQEESPPPVVPATCSRKRGRPPLTPSQRAEREAARAGPEGTSPPTPTPSTATGGPPEDSPTVAPKSTTFLKNIRQFIMPVVSARSSRVIKTPRRFMDEDPPKPPKVEVSPVLRPPITTSPPVPQEPAPVPSPPRAPTPPSTPVPLPEKRRSILREPTFRWTSLTRELPPPPPAPPPPPAPSPPPAPATSSRRPLLLRAPQFTPSEAHLKIYESVLTPPPLGAPEAPEPEPPPADDSPAEPEPRAVGRTNHLSLPRFAPVVTTPVKAEVSPHGAPALSNGPQTQAQLLQPLQALQTQLLPQALPPPQPQLQPPPSPQQMPPLEKARIAGVGSLPLSGVEEKMFSLLKRAKVQLFKIDQQQQQKVAASMPLSPGGQMEEVAGAVKQISDRGPVRSEDESVEAKRERPSGPESPVQGPRIKHVCRHAAVALGQARAMVPEDVPRLSALPLRDRQDLATEDTSSASETESVPSRSRRGKVEAAGPGGESEPTGSGGTLAHTPRRSLPSHHGKKMRMARCGHCRGCLRVQDCGSCVNCLDKPKFGGPNTKKQCCVYRKCDKIEARKMERLAKKGRTIVKTLLPWDSDESPEASPGPPGPRRGAGAGGPREEVVAHPGPEEQDSLLQRKSARRCVKQRPSYDIFEDSDDSEPGGPPAPRRRTPRENELPLPEPEEQSRPRKPTLQPVLQLKARRRLDKDALAPGPFASFPNGWTGKQKSPDGVHRVRVDFKEDCDLENVWLMGGLSVLTSVPGGPPMVCLLCASKGLHELVFCQVCCDPFHPFCLEEAERPLPQHHDTWCCRRCKFCHVCGRKGRGSKHLLECERCRHAYHPACLGPSYPTRATRKRRHWICSACVRCKSCGATPGKNWDVEWSGDYSLCPRCTQLYEKGNYCPICTRCYEDNDYESKMMQCAQCDHWVHAKCEGLSDEDYEILSGLPDSVLYTCGPCAGAAQPRWREALSGALQGGLRQVLQGLLSSKVVGPLLLCTQCGPDGKQLHPGPCGLQAVSQRFEDGHYKSVHSFMEDMVGILMRHSEEGETPDRRAGGQMKGLLLKLLESAFGWFDAHDPKYWRRSTRLPNGVLPNAVLPPSLDHVYAQWRQQEPETPESGQPPGDPSAAFQGKDPAAFSHLEDPRQCALCLKYGDADSKEAGRLLYIGQNEWTHVNCAIWSAEVFEENDGSLKNVHAAVARGRQMRCELCLKPGATVGCCLSSCLSNFHFMCARASYCIFQDDKKVFCQKHTDLLDGKEIVNPDGFDVLRRVYVDFEGINFKRKFLTGLEPDAINVLIGSIRIDSLGTLSDLSDCEGRLFPIGYQCSRLYWSTVDARRRCWYRCRILEYRPWGPREEPAHLEAAEENQTIVHSPAPSSEPPGGEDPPLDTDVLVPGAPERHSPIQNLDPPLRPDSGSAPPPAPRSFSGARIKVPNYSPSRRPLGGVSFGPLPSPGSPSSLTHHIPTVGDPDFPAPPRRSRRPSPLAPRPPPSRWASPPLKTSPQLRVPPPTSVVTALTPTSGELAPPGPAPSPPPPEDLGPDFEDMEVVSGLSAADLDFAASLLGTEPFQEEIVAAGAMGSSHGGPGDSSEEESSPTSRYIHFPVTVVSAPGLAPSATPGAPRIEQLDGVDDGTDSEAEAVQQPRGQGTPPSGPGVVRAGVLGAAGDRARPPEDLPSEIVDFVLKNLGGPGDGGAGPREESLPPAPPLANGSQPSQGLTASPADPTRTFAWLPGAPGVRVLSLGPAPEPPKPATSKIILVNKLGQVFVKMAGEGEPVPPPVKQPPLPPTISPTAPTSWTLPPGPLLGVLPVVGVVRPAPPPPPPPLTLVLSSGPASPPRQAIRVKRVSTFSGRSPPAPPPYKAPRLDEDGEASEDTPQVPGLGSGGFSRVRMKTPTVRGVLDLDRPGEPAGEESPGPLQERSPLLPLPEDGPPQVPDGPPDLLLESQWHHYSGEASSSEEEPPSPDDKENQAPKRTGPHLRFEISSEDGFSVEAESLEGAWRTLIEKVQEARGHARLRHLSFSGMSGARLLGIHHDAVIFLAEQLPGAQRCQHYKFRYHQQGEGQEEPPLNPHGAARAEVYLRKCTFDMFNFLASQHRVLPEGATCDEEEDEVQLRSTRRATSLELPMAMRFRHLKKTSKEAVGVYRSAIHGRGLFCKRNIDAGEMVIEYSGIVIRSVLTDKREKFYDGKGIGCYMFRMDDFDVVDATMHGNAARFINHSCEPNCFSRVIHVEGQKHIVIFALRRILRGEELTYDYKFPIEDASNKLPCNCGAKRCRRFLN

SEQ ID NO: 47794 - protein, 4911 aa, Homo sapiens
  Payload ID: 9665
  Gene Symbol: KMT2C
  Gene Name: lysine (K)-specific methyltransferase 2C
  Uniprot ID: Q8NEZ4
  ENSP ID: ENSP00000262189
MSSEEDKSVEQPQPPPPPPEEPGAPAPSPAAADKRPRGRPRKDGASPFQRARKKPRSRGKTAVEDEDSMDGLETTETETIVETEIKEQSAEEDAEAEVDNSKQLIPTLQRSVSEESANSLVSVGVEAKISEQLCAFCYCGEKSSLGQGDLKQFRITPGFILPWRNQPSNKKDIDDNSNGTYEKMQNSAPRKQRGQRKERSPQQNIVSCVSVSTQTASDDQAGKLWDELSLVGLPDAIDIQALFDSTGTCWAHHRCVEWSLGVCQMEEPLLVNVDKAVVSGSTERCAFCKHLGATIKCCEEKCTQMYHYPCAAGAGTFQDFSHIFLLCPEHIDQAPERSKEDANCAVCDSPGDLLDQFFCTTCGQHYHGMCLDIAVTPLKRAGWQCPECKVCQNCKQSGEDSKMLVCDTCDKGYHTFCLQPVMKSVPTNGWKCKNCRICIECGTRSSSQWHHNCLICDNCYQQQDNLCPFCGKCYHPELQKDMLHCNMCKRWVHLECDKPTDHELDTQLKEEYICMYCKHLGAEMDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRFVLRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 47795 - protein, 4911 aa, Homo sapiens; identical to SEQ ID NO: 47794
  Payload ID: 9665
  Gene Symbol: KMT2C
  Gene Name: lysine (K)-specific methyltransferase 2C
  Uniprot ID: Q8NEZ4
  ENSP ID: ENSP00000347325

SEQ ID NO: 47796 - protein, 2441 aa, Homo sapiens
  Payload ID: 9665
  Gene Symbol: KMT2C
  Gene Name: lysine (K)-specific methyltransferase 2C
  ENSP ID: ENSP00000353218
  MOD_RES (1)..(1): Any amino acid
XERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQLSLLPLMEPIIGVNFAHFLPYGSGQFNSGNRLLGTFGSATLEGVSDYYSQLIYKQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEEVRV

SEQ ID NO: 47797 - protein, 228 aa, Homo sapiens
  Payload ID: 9665
  Gene Symbol: KMT2C
  Gene Name: lysine (K)-specific methyltransferase 2C
  ENSP ID: ENSP00000403483
  MOD_RES (1)..(1): Any amino acid
XSSAGNIMPTTYISVTPKIGMGKPAITKRKFSPGRPRSKQGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQ

SEQ ID NO: 47798 - protein, 236 aa, Homo sapiens
  Payload ID: 9665
  Gene Symbol: KMT2C
  Gene Name: lysine (K)-specific methyltransferase 2C
  ENSP ID: ENSP00000408001
TKDNKLVEKQNPAEGLQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIP

SEQ ID NO: 47799 - protein, 155 aa, Homo sapiens
  Payload ID: 9665
  Gene Symbol: KMT2C
  Gene Name: lysine (K)-specific methyltransferase 2C
  ENSP ID: ENSP00000410239
MSSEEDKSVEQPQPPPPPPEEPGAPAPSPAAADKRPRGRPRKDGASPFQRARKKPRSRGKTAVEDEDSMDGLETTETETIVETAEIKEQSAEEDAEAEVDNSKQLIPTLQRSVSEESANSLVSVGVEAKISEQLCAFCYCGEKSSLGQGDLKQFR

SEQ ID NO: 47800 - protein, 1524 aa, Homo sapiens
  Payload ID: 9665
  Gene Symbol: KMT2C
  Gene Name: lysine (K)-specific methyltransferase 2C
  ENSP ID: ENSP00000410411
LMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQLSLLPLMEPIIGVNFAHFLPYGSGQFNSGNRLLGTFGSATLEGVSDYYSQLIYKKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 47801 - protein, 826 aa, Homo sapiens
  Payload ID: 9665
  Gene Symbol: KMT2C
  Gene Name: lysine (K)-specific methyltransferase 2C
  ENSP ID: ENSP00000453752
MSSEEDKSVEQPQPPPPPPEEPGAPAPSPAAADKRPRGRPRKDGASPFQRARKKPRSRGKTAVEDEDSMDGLETTETETIVETEIKEQSAEEDAEAEVDNSKQLIPTLQRSVSEESANSLVSVGVEAKISEQLCAFCYCGEKSSLGQGDLKQFRITPGFILPWRNQPSNKKDIDDNSNGTYEKMQNSAPRKQRGQRKERSPQQNIVSCVSVSTQTASDDQAGKLWDELSLVGLPDAIDIQALFDSTGTCWAHHRCVEWSLGVCQMEEPLLVNVDKAVVSGSTERCAFCKHLGATIKCCEEKCTQMYHYPCAAGAGTFQDFSHIFLLCPEHIDQAPERSKEDANCAVCDSPGDLLDQFFCTTCGQHYHGMCLDIAVTPLKRAGWQCPECKVCQNCKQSGEDSKMLVCDTCDKGYHTFCLQPVMKSVPTNGWKCKNCRICIECGTRSSSQWHHNCLICDNCYQQQDNLCPFCGKCYHPELQKDMLHCNMCKRWVHLECDKPTDHELDTQLKEEYICMYCKHLGAEMDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMG

SEQ ID NO: 47802 - protein, 179 aa, Homo sapiens
  Payload ID: 9665
  Gene Symbol: KMT2C
  Gene Name: lysine (K)-specific methyltransferase 2C
  ENSP ID: ENSP00000454058
VFSPGSSNSRPPSPMDPYAKMRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHF

SEQ ID NO: 47803 - protein, 5537 aa, Homo sapiens
  Payload ID: 9666
  Gene Symbol: KMT2D
  Gene Name: lysine (K)-specific methyltransferase 2D
  Uniprot ID: O14686
  ENSP ID: ENSP00000301067
MDSQKLAGEDKDSEPAADGPAASEDPSATESDLPNPHVGEVSVLSSGSPRLQETPQDCSGGPVRRCALCNCGEPSLHGQRELRRFELPFDWPRCPVVSPGGSPGPNEAVLPSEDLSQIGFPEGLTPAHLGEPGGSCWAHHWCAAWSAGVWGQEGPELCGVDKAIFSGISQRCSHCTRLGASIPCRSPGCPRLYHFPCATASGSFLSMKTLQLLCPEHSEGAAYLEEARCAVCEGPGELCDLFFCTSCGHHYHGACLDTALTARKRAGWQCPECKVCQACRKPGNDSKMLVCETCDKGYHTFCLKPPMEELPAHSWKCKACRVCRACGAGSAELNPNSEWFENYSLCHRCHKAQGGQTIRSVAEQHTPVCSRFSPPEPGDTPTDEPDALYVACQGQPKGGHVTSMQPKEPGPLQCEAKPLGKAGVQLEPQLEAPLNEEMPLLPPPEESPLSPPPEESPTSPPPEASRLSPPPEELPASPLPEALHLSRPLEESPLSPPPEESPLSPPPESSPFSPLEESPLSPPEESPPSPALETPLSPPPEASPLSPPFEESPLSPPPEELPTSPPPEASRLSPPPEESPMSPPPEESPMSPPPEASRLFPPFEESPLSPPPEESPLSPPPEASRLSPPPEDSPMSPPPEESPMSPPPEVSRLSPLPVVSRLSPPPEESPLSPPPEESPTSPPPEASRLSPPPEDSPTSPPPEDSPASPPPEDSLMSLPLEESPLLPLPEEPQLCPRSEGPHLSPRPEEPHLSPRPEEPHLSPQAEEPHLSPQPEEPCLCAVPEEPHLSPQAEGPHLSPQPEELHLSPQTEEPHLSPVPEEPCLSPQPEESHLSPQSEEPCLSPRPEESHLSPELEKPPLSPRPEKPPEEPGQCPAPEELPLFPPPGEPSLSPLLGEPALSEPGEPPLSPLPEELPLSPSGEPSLSPQLMPPDPLPPPLSPIITAAAPPALSPLGELEYPFGAKGDSDPESPLAAPILETPISPPPEANCTDPEPVPPMILPPSPGSPVGPASPILMEPLPPQCSPLLQHSLVPQNSPPSQCSPPALPLSVPSPLSPIGKVVGVSDEAELHEMETEKVSEPECPALEPSATSPLPSPMGDLSCPAPSPAPALDDFSGLGEDTAPLDGIDAPGSQPEPGQTPGSLASELKGSPVLLDPEELAPVTPMEVYPECKQTAGQGSPCEEQEEPRAPVAPTPPTLIKSDIVNEISNLSQGDASASFPGSEPLLGSPDPEGGGSLSMELGVSTDVSPARDEGSLRLCTDSLPETDDSLLCDAGTAISGGKAEGEKGRRRSSPARSRIKQGRSSSFPGRRRPRGGAHGGRGRGRARLKSTASSIETLVVADIDSSPSKEEEEEDDDTMQNTVVLFSNTDKFVLMQDMCVVCGSFGRGAEGHLLACSQCSQCYHPYCVNSKITKVMLLKGWRCVECIVCEVCGQASDPSRLLLCDDCDISYHTYCLDPPLLTVPKGGWKCKWCVSCMQCGAASPGFHCEWQNSYTHCGPCASLVTCPICHAPYVEEDLLIQCRHCERWMHAGCESLFTEDDVEQAADEGFDCVSCQPYVVKPVAPVAPPELVPMKVKEPEPQYFRFEGVWLTETGMALLRNLTMSPLHKRRQRRGRLGLPGEAGLEGSEPSDALGPDDKKDGDLDTDELLKGEGGVEHMECEIKLEGPVSPDVEPGKEETEESKKRKRKPYRPGIGGFMVRQRKSHTRTKKGPAAQAEVLSGDGQPDEVIPADLPAEGAVEQSLAEGDEKKKQQRRGRKKSKLEDMFPAYLQEAFFGKELLDLSRKALFAVGVGRPSFGLGTPKAKGDGGSERKELPTSQKGDDGPDIADEESRGLEGKADTPGPEDGGVKASPVPSDPEKPGTPGEGMLSSDLDRISTEELPKMESKDLQQLFKDVLGSEREQHLGCGTPGLEGSRTPLQRPFLQGGLPLGNLPSSSPMDSYPGLCQSPFLDSRERGGFFSPEPGEPDSPWTGSGGTTPSTPTTPTTEGEGDGLSYNQRSLQRWEKDEELGQLSTISPVLYANINFPNLKQDYPDWSSRCKQIMKLWRKVPAADKAPYLQKAKDNRAAHRINKVQKQAESQINKQTKVGDIARKTDRPALHLRIPPQPGALGSPPPAAAPTIFIGSPTTPAGLSTSADGFLKPPAGSVPGPDSPGELFLKLPPQVPAQVPSQDPFGLAPAYPLEPRFPTAPPTYPPYPSPTGAPAQPPMLGASSRPGAGQPGEFHTTPPGTPRHQPSTPDPFLKPRCPSLDNLAVPESPGVGGGKASEPLLSPPPFGESRKALEVKKEELGASSPSYGPPNLGFVDSPSSGTHLGGLELKTPDVFKAPLTPRASQVEPQSPGLGLRPQEPPPAQALAPSPPSHPDIFRPGSYTDPYAQPPLTPRPQPPPPESCCALPPRSLPSDPFSRVPASPQSQSSSQSPLTPRPLSAEAFCPSPVTPRFQSPDPYSRPPSRPQSRDPFAPLHKPPRPQPPEVAFKAGSLAHTSLGAGGFPAALPAGPAGELHAKVPSGQPPNFVRSPGTGAFVGTPSPMRFTFPQAVGEPSLKPPVPQPGLPPPHGINSHFGPGPTLGKPQSTNYTVATGNFHPSGSPLGPSSGSTGESYGLSPLRPPSVLPPPAPDGSLPYLSHGASQRSGITSPVEKREDPGTGMGSSLATAELPGTQDPGMSGLSQTELEKQRQRQRLRELLIRQQIQRNTLRQEKETAAAAAGAVGPPGSWGAEPSSPAFEQLSRGQTPFAGTQDKSSLVGLPPSKLSGPILGPGSFPSDDRLSRPPPPATPSSMDVNSRQLVGGSQAFYQRAPYPGSLPLQQQQQQLWQQQQATAATSMRFAMSARFPSTPGPELGRQALGSPLAGISTRLPGPGEPVPGPAGPAQFIELRHNVQKGLGPGGTPFPGQGPPQRPRFYPVSEDPHRLAPEGLRGLAVSGLPPQKPSAPPAPELNNSLHPTPHTKGPTLPTGLELVNRPPSSTELGRPNPLALEAGKLPCEDPELDDDFDAHKALEDDEELAHLGLGVDVAKGDDELGTLENLETNDPHLDDLLNGDEFDLLAYTDPELDTGDKKDIFNEHLRLVESANEKAEREALLRGVEPGPLGPEERPPPAADASEPRLASVLPEVKPKVEEGGRHPSPCQFTIATPKVEPAPAANSLGLGLKPGQSMMGSRDTRMGTGPFSSSGHTAEKASFGATGGPPAHLLTPSPLSGPGGSSLLEKFELESGALTLPGGPAASGDELDKMESSLVASELPLLIEDLLEHEKKELQKKQQLSAQLQPAQQQQQQQQQHSLLSAPGPAQAMSLPHEGSSPSLAGSQQQLSLGLAGARQPGLPQPLMPTQPPAHALQQRLAPSMAMVSNQGHMLSGQHGGQAGLVPQQSSQPVLSQKPMGTMPPSMCMKPQQLAMQQQLANSFFPDTDLDKFAAEDIIDPIAKAKMVALKGIKKVMAQGSIGVAPGMNRQQVSLLAQRLSGGPSSDLQNHVAAGSGQERSAGDPSQPRPNPPTFAQGVINEADQRQYEEWLFHTQQLLQMQLKVLEEQIGVHRKSRKALCAKQRTAKKAGREFPEADAEKLKLVTEQQSKIQKQLDQVRKQQKEHTNLMAEYRNKQQQQQQQQQQQQQQHSAVLALSPSQSPRLLTKLPGQLLPGHGLQPPQGPPGGQAGGLRLTPGGMALPGQPGGPFLNTALAQQQQQQHSGGAGSLAGPSGGFFPGNLALRSLGPDSRLLQERQLQLQQQRMQLAQKLQQQQQQQQQQQHLLGQVAIQQQQQQGPGVQTNQALGPKPQGLMPPSSHQGLLVQQLSPQPPQGPQGMLGPAQVAVLQQQHPGALGPQGPHRQVLMTQSRVLSSPQLAQQGQGLMGHRLVTAQQQQQQQQHQQQGSMAGLSHLQQSLMSHSGQPKLSAQPMGSLQQLQQQQQLQQQQQLQQQQQQQLQQQQQLQQQQLQQQQQQQQLQQQQQQQLQQQQQQLQQQQQQQQQQFQQQQQQQQMGLLNQSRTLLSPQQQQQQQVALGPGMPAKPLQHFSSPGALGPTLLLTGKEQNTVDPAVSSEATEGPSTHQGGPLAIGTTPESMATEPGEVKPSLSGDSQLLLVQPQPQPQPSSLQLQPPLRLPGQQQQQVSLLHTAGGGSHGQLGSGSSSEASSVPHLLAQPSVSLGDQPGSMTQNLLGPQQPMLERPMQNNTGPQPPKPGPVLQSGQGLPGVGIMPTVGQLRAQLQGVLAKNPQLRHLSPQQQQQLQALLMQRQLQQSQAVRQTPPYQEPGTQTSPLQGLLGCQPQLGGFPGPQTGPLQELGAGPRPQGPPRLPAPPGALSTGPVLGPVHPTPPPSSPQEPKRPSQLPSPSSQLPTEAQLPPTHPGTPKPQGPTLEPPPGRVSPAAAQLADTLFSKGLGPWDPPDNLAETQKPEQSSLVPGHLDQVNGQVVPEASQLSIKQEPREEPCALGAQSVKREANGEPIGAPGTSNHLLLAGPRSEAGHLLLQKLLRAKNVQLSTGRGSEGLRAEINGHIDSKLAGLEQKLQGTPSNKEDAAARKPLTPKPKRVQKASDRLVSSRKKLRKEDGVRASEALLKQLKQELSLLPLTEPAITANFSLFAPFGSGCPVNGQSQLRGAFGSGALPTGPDYYSQLLTKNNLSNPPTPPSSLPPTPPPSVQQKMVNGVTPSEELGEHPKDAASARDSERALRDTSEVKSLDLLAALPTPPHNQTEDVRMESDEDSDSPDSIVPASSPESILGEEAPRFPHLGSGRWEQEDRALSPVIPLIPRASIPVFPDTKPYGALGLEVPGKLPVTTWEKGKGSEVSVMLTVSAAAAKNLNGVMVAVAELLSMKIPNSYEVLFPESPARAGTEPKKGEAEGPGGKEKGLEGKSPDTGPDWLKQFDAVLPGYTLKSQLDILSLLKQESPAPEPPTQHSYTYNVSNLDVRQLSAPPPEEPSPPPSPLAPSPASPPTEPLVELPTEPLAEPPVPSPLPLASSPESARPKPRARPPEEGEDSRPPRLKKWKGVRWKRLRLLLTIQKGSGRQEDEREVAEFMEQLGTALRPDKVPRDMRRCCFCHEEGDGATDGPARLLNLDLDLWVHLNCALWSTEVYETQGGALMNVEVALHRGLLTKCSLCQRTGATSSCNRMRCPNVYHFACAIRAKCMFFKDKTMLCPMHKIKGPCEQELSSFAVFRRVYIERDEVKQIASIIQRGERLHMFRVGGLVFHAIGQLLPHQMADFHSATALYPVGYEATRIYWSLRTNNRRCCYRCSIGENNGRPEFVIKVIEQGLEDLVFTDASPQAVWNRIIEPVAAMRKEADMLRLFPEYLKGEELFGLTVHAVLRIAESLPGVESCQNYLFRYGRHPLMELPLMINPTGCARSEPKILTHYKRPHTLNSTSMSKAYQSTFTGETNTPYSKQFVHSKSSQYRRLRTEWKNNVYLARSRIQGLGLYAAKDLEKHTMVIEYIGTIIRNEVANRREKIYEEQNRGIYMFRINNEHVIDATLTGGPARYINHSCAPNCVAEVVTFDKEDKIIIISSRRIPKGEELTYDYQFDFEDDQHKIPCHCGAWNCRKWMN

SEQ ID NO: 47804 - protein, 218 aa, Homo sapiens
  Payload ID: 9666
  Gene Symbol: KMT2D
  Gene Name: lysine (K)-specific methyltransferase 2D
  ENSP ID: ENSP00000435714
TGCARSEPKILTHYKRVFTSIISFDPHNNLMRPHTLNSTSMSKAYQSTFTGETNTPYSKQFVHSKSSQYRRLRTEWKNNVYLARSRIQGLGLYAAKDLEKHTMVIEYIGTIIRNEVANRREKIYEEQNRGIYMFRINNEHVIDATLTGGPARYINHSCAPNCVAEVVTFDKEDKIIIISSRRIPKGEELTYDYQFDFEDDQHKIPCHCGAWNCRKWMN

SEQ ID NO: 47805 - protein, 145 aa, Homo sapiens
  Payload ID: 9666
  Gene Symbol: KMT2D
  Gene Name: lysine (K)-specific methyltransferase 2D
  ENSP ID: ENSP00000449455
MDSQKLAGEDKDSEPAADGPAASEDPSATESDLPNPHVGEVSVLSSGSPRLQETPQDCSGGPVRRCALCNCGEPSLHGQRELRRFELPFDWPRCPVVSPGGSPGPNEAVLPSEDLSQIGFPEGLTPAHLGEPGGSCWAHHWCAAW

SEQ ID NO: 47806 - protein, 1858 aa, Homo sapiens
  Payload ID: 9667
  Gene Symbol: KMT2E
  Gene Name: lysine (K)-specific methyltransferase 2E
  Uniprot ID: Q8IZD2
  ENSP ID: ENSP00000257745
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETSTPTPSPYATPTHTDITPMDPSFATPPRIKSDDETCRNGYKPIYSPVTPVTPGTPGNTMHFENISSPESSPEIKRRTYSQEGYDRSSTMLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYSQFNQQSLNSTAPPPPPPPPPSSSYYQNQQPSANFQNYNQLKGSLSQQTVFTSGPNQALPGTTSQQTVPGHHVTPGHFLPSQNPTIHHQTAAAVVPPPPPPPPAPGPHLVQQPNSHQQHSVAHVVGPVHAVTPGSHIHSQTAGHHLPPPPPPPGPAPHHHPPPHPSTGLQGLQAQHQHVVNSAPPPPPPPPPSSVLASGHHTTSAQALHHPPHQGPPLFPSSAHPTVPPYPSQATHHTTLGPGPQHQPSGTGPHCPLPVTGPHLQPQGPNSIPTPTASGFCPHPGSVALPHGVQGPQQASPVPGQIPIHRAQVPPTFQNNYHGSGWH

SEQ ID NO: 47807 - protein, 1858 aa, Homo sapiens; identical to SEQ ID NO: 47806
  Payload ID: 9667
  Gene Symbol: KMT2E
  Gene Name: lysine (K)-specific methyltransferase 2E
  Uniprot ID: Q8IZD2
  ENSP ID: ENSP00000312379

SEQ ID NO: 47808 - protein, 1778 aa, Homo sapiens
  Payload ID: 9667
  Gene Symbol: KMT2E
  Gene Name: lysine (K)-specific methyltransferase 2E
  ENSP ID: ENSP00000333986
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETSTPTPSPYATPTHTDITPMDPSFATPPRIKSDDETCRNGYKPIYSPVTPVTPGTPGNTMHFENISSPESSPEIKRRTYSQEGYDRSSTMLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYSQFNQQSLNSTAPPPPPPPPPSSSYYQNQQPSANFQNYNQLKGSLSQQTVFTSGPNQALPGTTSQQTVPGHHVTPGHFLPSQNPTIHHQTAAAVVPPPPPPPPAPGPHLVQQPNSHQQHSVAHVVGPVHAVTPGSHIHSQTAGHHLPPPPPPPGPAPHHHPPPHPSTGLQGLQAQHQHVVNSAPPPPPPPPPSSVLASGHHTTSAQALHHPPHQGPPLFPSSAHPTVPPYPSQATHHTTLGPGPQHQPSGTGPHCPLPVTGPHLQPQGPNSIPTPTASGFCPHPGSVALPHGVQGPQQASPVPGQIPIHRAQVPPTFQNNYHGSGWH

SEQ ID NO: 47809 - protein, 865 aa, Homo sapiens
  Payload ID: 9667
  Gene Symbol: KMT2E
  Gene Name: lysine (K)-specific methyltransferase 2E
  Uniprot ID: Q8IZD2
  ENSP ID: ENSP00000335398
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNEYFFPRKFSRNKETHL

SEQ ID NO: 47810 - protein, 125 aa, Homo sapiens
  Payload ID: 9667
  Gene Symbol: KMT2E
  Gene Name: lysine (K)-specific methyltransferase 2E
  ENSP ID: ENSP00000417156
  MOD_RES (1)..(1): Any amino acid
XGSLSNNGDGCASSNDNGEQVDHTASLPLPTPATVYNATSEETSNNCPVKDATASEKNEPEVQWTASTSVEQVRERSYQRALLLSDHRKDKDSDPDPENPEPTTTNECPSPDTSQNTCKSPPKMS

SEQ ID NO: 47811 - protein, 144 aa, Homo sapiens
  Payload ID: 9667
  Gene Symbol: KMT2E
  Gene Name: lysine (K)-specific methyltransferase 2E
  ENSP ID: ENSP00000417193
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSTLESP

SEQ ID NO: 47812 - protein, 609 aa, Homo sapiens
  Payload ID: 9667
  Gene Symbol: KMT2E
  Gene Name: lysine (K)-specific methyltransferase 2E
  Uniprot ID: Q8IZD2
  ENSP ID: ENSP00000417888
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMVSWEASSLGLVTAALHMVIVAAFTWAFTLFFEVSE

SEQ ID NO: 47813 - protein, 21 aa, Homo sapiens
  Payload ID: 9667
  Gene Symbol: KMT2E
  Gene Name: lysine (K)-specific methyltransferase 2E
  ENSP ID: ENSP00000419525
  MOD_RES (1)..(1): Any amino acid
XQNPPQKKKSPVGNFVGSNVV

SEQ ID NO: 47814 - protein, 352 aa, Homo sapiens
  Payload ID: 9667
  Gene Symbol: KMT2E
  Gene Name: lysine (K)-specific methyltransferase 2E
  ENSP ID: ENSP00000419883
MSIVIPLGVDTAETSYLEMAAGSENLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKK

SEQ ID NO: 47815 - protein, 71 aa, Homo sapiens
  Payload ID: 9667
  Gene Symbol: KMT2E
  Gene Name: lysine (K)-specific methyltransferase 2E
  ENSP ID: ENSP00000420206
MSIVIPLGVDTAETSYLEMAAGSEPESVEASPVVVEKSNSYPHQLYTSSSHHSHSYIGLPYADHNYGARPP

SEQ ID NO: 47816 - protein, 230 aa, Homo sapiens
  Payload ID: 9667
  Gene Symbol: KMT2E
  Gene Name: lysine (K)-specific methyltransferase 2E
  ENSP ID: ENSP00000420415
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKK

SEQ ID NO: 47817 - protein, 144 aa, Homo sapiens
  Payload ID: 9667
  Gene Symbol: KMT2E
  Gene Name: lysine (K)-specific methyltransferase 2E
  ENSP ID: ENSP00000473963
  MOD_RES (1)..(1): Any amino acid
XLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKV

SEQ ID NO: 47818 - protein, 453 aa, Homo sapiens [sequence omitted]

SEQ ID NO: 47819 - protein, 259 aa, Homo sapiens
  Payload ID: 9668
  Gene Symbol: KRCC1
  Gene Name: lysine-rich coiled-coil 1
  Uniprot ID: Q9NPI7
  ENSP ID: ENSP00000340083
MKHSKKTYDSFQDELEDYIKVQKARGLEPKTCFRKMKGDYLETCGYKGEVNSRPTYRMFDQRLPSETIQTYPRSCNIPQTVENRLPQWLPAHDSRLRLDSLSYCQFTRDCFSEKPVPLNFNQQEYICGSHGVEHRVYKHFSSDNSTSTHQASHKQIHQKRKRHPEEGREKSEEERSKHKRKKSCEEIDLDKHKSIQRKKTEVEIETVHVSTEKLKNRKEKKSRDVVSKKEERKRTKKKKEQGQERTEEEMLWDQSILGF

SEQ ID NO: 47820 - protein, 458 aa, Homo sapiens
  Payload ID: 9669
  Gene Symbol: KNOP1
  Gene Name: lysine-rich nucleolar protein 1
  Uniprot ID: Q1ED39
  ENSP ID: ENSP00000219837
MITKTHKVDLGLPEKKKKKKVVKEPETRYSVLNNDDYFADVSPLRATSPSKSVAHGQAPEMPLVKKKKKKKKGVSTLCEEHVEPETTLPARRTEKSPSLRKQVFGHLEFLSGEKKNKKSPLAMSHASGVKTSPDPRQGEEETRVGKKLKKHKKEKKGAQDPTAFSVQDPWFCEAREARDVGDTCSVGKKDEEQAALGQKRKRKSPREHNGKVKKKKKIHQEGDALPGHSKPSRSMESSPRKGSKKKPVKVEAPEYIPISDDPKASAKKKMKSKKKVEQPVIEEPALKRKKKKKRKESGVAGDPWKEETDTDLEVVLEKKGNMDEAHIDQVRRKALQEEIDRESGKTEASETRKWTGTQFGQWDTAGFENEDQKLKFLRLMGGFKNLSPSFSRPASTIARPNMALGKKAADSLQQNLQRDYDRAMSWKYSRGAGLGFSTAPNKIFYIDRNASKSVKLED

SEQ ID NO: 47821 - protein, 79 aa, Homo sapiens
  Payload ID: 9669
  Gene Symbol: KNOP1
  Gene Name: lysine-rich nucleolar protein 1
  ENSP ID: ENSP00000454329
MITKTHKVDLGLPEKKKKKKVVKEPETRYSVLNNDDYFADVSPLRATSPSKSVAHGQAPEMPLVKKKKKKKKGVSTLCE

SEQ ID NO: 47822 - protein, 137 aa, Homo sapiens
  Payload ID: 9669
  Gene Symbol: KNOP1
  Gene Name: lysine-rich nucleolar protein 1
  ENSP ID: ENSP00000455015
MDEAHIDQVRRKALQEEIDRESGKTEASETRKWTGTQFGQWDTAGFENEDQKLKFLRLMGGFKNLSPSFSRPASTIARPNMALGKKAADSLQQNLQRDYDRAMSWKYSRGAGLGFSTAPNKIFYIDRNASKSVKLED

SEQ ID NO: 47823 - protein, 199 aa, Homo sapiens
  Payload ID: 9669
  Gene Symbol: KNOP1
  Gene Name: lysine-rich nucleolar protein 1
  ENSP ID: ENSP00000455369
  MOD_RES (1)..(1): Any amino acid
XEKKGAQDPTAFSVQDPWFCEAREARDVGDTCSVGKKDEEQAALGQKRKRKSPREHNGKVKKKKKIHQEGDALPGHSKPSRSMESSPRKGSKKKPVKVEAPEYIPISDDPKASAKKKMKSKKKVEQPVIEEPALKRKKKKKRKESGVAGDPWKEVRRKALQEEIDRESGKTEASETRKWTGTQFGQWDTAGFENEDQKL

SEQ ID NO: 47824 - protein, 227 aa, Homo sapiens
  Payload ID: 9670
  Gene Symbol: LYSMD1
  Gene Name: LysM, putative peptidoglycan-binding, domain containing 1
  Uniprot ID: Q96S90
  ENSP ID: ENSP00000357904
MASPSRQPPPGGSGLLQGSRARSYGSLVQSACSPVRERRLEHQLEPGDTLAGLALKYGVTMEQIKRANRLYTNDSIFLKKTLYIPILTEPRDLFNGLDSEEEKDGEEKVHPSNSEVWPHSTERKKQETGAGRANGEVLPTPGQETPTPIHDLSASDFLKKLDSQISLSKKAAAQKLKKGENGVPGEDAGLHLSSPWMQQRAVLGPVPLTRTSRTRTLRDQEDEIFKL

SEQ ID NO: 47825 - protein, 179 aa, Homo sapiens
  Payload ID: 9670
  Gene Symbol: LYSMD1
  Gene Name: LysM, putative peptidoglycan-binding, domain containing 1
  Uniprot ID: Q96S90
  ENSP ID: ENSP00000404059
MRSGPLRISEWKMEQIKRANRLYTNDSIFLKKTLYIPILTEPRDLFNGLDSEEEKDGEEKVHPSNSEVWPHSTERKKQETGAGRANGEVLPTPGQETPTPIHDLSASDFLKKLDSQISLSKKAAAQKLKKGENGVPGEDAGLHLSSPWMQQRAVLGPVPLTRTSRTRTLRDQEDEIFKL

SEQ ID NO: 47826 - protein, 215 aa, Homo sapiens
  Payload ID: 9671
  Gene Symbol: LYSMD2
  Gene Name: LysM, putative peptidoglycan-binding, domain containing 2
  Uniprot ID: Q8IV50
  ENSP ID: ENSP00000267838
MADSSPALSLREGGPRAPRPSAPSPPPRSRSGSESEEAELSLSLARTKTRSYGSTASVRAPLGAGVIERHVEHRVRAGDTLQGIALKYGVTMEQIKRANKLFTNDCIFLKKTLNIPVISEKPLLFNGLNSIDSPENETADNSFSQEEEPVVAGEDLPPPSPQESDVQPVQPEEVSARDFLQRLDLQIKLSTQAAKKLKEESRDEESPYATSLYHS

SEQ ID NO: 47827 - protein, 124 aa, Homo sapiens
  Payload ID: 9671
  Gene Symbol: LYSMD2
  Gene Name: LysM, putative peptidoglycan-binding, domain containing 2
  Uniprot ID: Q8IV50
  ENSP ID: ENSP00000410424
MEQIKRANKLFTNDCIFLKKTLNIPVISEKPLLFNGLNSIDSPENETADNSFSQEEEPVVAGEDLPPPSPQESDVQPVQPEEVSARDFLQRLDLQIKLSTQAAKKLKEESRDEESPYATSLYHS

SEQ ID NO: 47828 - protein, 108 aa, Homo sapiens
  Payload ID: 9671
  Gene Symbol: LYSMD2
  Gene Name: LysM, putative peptidoglycan-binding, domain containing 2
  ENSP ID: ENSP00000452715
MAKAFKPVMSIPVSEHPDTEAALRAVSENETADNSFSQEEEPVVAGEDLPPPSPQESDVQPVQPEEVSARDFLQRLDLQIKLSTQAAKKLKEESRDEESPYATSLYHS

SEQ ID NO: 47829 - protein, 124 aa, Homo sapiens; identical to SEQ ID NO: 47827
  Payload ID: 9671
  Gene Symbol: LYSMD2
  Gene Name: LysM, putative peptidoglycan-binding, domain containing 2
  Uniprot ID: Q8IV50
  ENSP ID: ENSP00000453933

SEQ ID NO: 47830 - protein, 306 aa, Homo sapiens
  Payload ID: 9672
  Gene Symbol: LYSMD3
  Gene Name: LysM, putative peptidoglycan-binding, domain containing 3
  Uniprot ID: Q7Z3D4
  ENSP ID: ENSP00000314518
MAGRHQNRSFPLPGVQSSGQVHAFGNCSDSDILEEDAEVYELRSRGKEKVRRSTSRDRLDDIIVLTKDIQEGDTLNAIALQYCCTVADIKRVNNLISDQDFFALRSIKIPVKKFSSLTETLCPPKGRQTSRHSSVQYSSEQQEILPANDSLAYSDSAGSFLKEVDRDIEQIVKCTDNKRENLNEVVSALTAQQMRFEPDNKNTQRKDPYYGADWGIGWWTAVVIMLIVGIITPVFYLLYYEILAKVDVSHHSTVDSSHLHSKITPPSQQREMENGIVPTKGIHFSQQDDHKLYSQDSQSPAAQQET

SEQ ID NO: 47831 - protein, 90 aa, Homo sapiens
  Payload ID: 9672
  Gene Symbol: LYSMD3
  Gene Name: LysM, putative peptidoglycan-binding, domain containing 3
  ENSP ID: ENSP00000405507
MAGRHQNRSFPLPGVQSSGQVHAFGNCSDSDILEEDAEVYELRSRGKEKVRRSTSRDRLDDIIVLTKDIQEGDTLNAIALQYCCTCSISQ

SEQ ID NO: 47832 - protein, 150 aa, Homo sapiens
  Payload ID: 9672
  Gene Symbol: LYSMD3
  Gene Name: LysM, putative peptidoglycan-binding, domain containing 3
  Uniprot ID: Q7Z3D4
  ENSP ID: ENSP00000427020
MAGRHQNRSFPLPGVQSSGQVHAFGNCSDSDILEEDAEVYELRSRGKEKVRRSTSRDRLDDIIVLTKDIQEGDTLNAIALQYCCTLRWMLVIIQQWTLHIYIQKSHPHHSREKWKMELCQLKEYISANKMIINCIVKILSHLLLNRKHSN

SEQ ID NO: 47833 - protein, 127 aa, Homo sapiens
  Payload ID: 9672
  Gene Symbol: LYSMD3
  Gene Name: LysM, putative peptidoglycan-binding, domain containing 3
  Uniprot ID: Q7Z3D4
  ENSP ID: ENSP00000427683
MAGRHQNRSFPLPGVQSSGQVHAFGNCSDSDILEEDAEVYELRSRGKEKVRRSTSRDRLDDIIVLTKDIQEGDTLNAIALQYCCTVYQNSSKKVQFLDRNTLSSKRKTDFTSFICSILFRTTGNFAS

SEQ ID NO: 47834 - protein, 170 aa, Homo sapiens
  Payload ID: 9673
  Gene Symbol: LYSMD4
  Gene Name: LysM, putative peptidoglycan-binding, domain containing 4
  ENSP ID: ENSP00000333008
METHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 47835 - protein, 297 aa, Homo sapiens
  Payload ID: 9673
  Gene Symbol: LYSMD4
  Gene Name: LysM, putative peptidoglycan-binding, domain containing 4
  Uniprot ID: Q5XG99
  ENSP ID: ENSP00000342840
MAVGTRGTLLKKSLTVWFCGPGARSATRAVSTSLPRREQVTWCCCSGSWPRRTASTSWRCSMAANTFYFRPNGAGDTRQNLIPDFYAFRVINNGKVADIKKVNNFIREQDLYALKSVKIPVRNHGILMETHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 47836 - protein, 131 aa, Homo sapiens
  Payload ID: 9673
  Gene Symbol: LYSMD4
  Gene Name: LysM, putative peptidoglycan-binding, domain containing 4
  ENSP ID: ENSP00000368184
MDSTHPQHCACNSQIRPRWDCVAHCFLWAPGLPSRDDPGADKGEASGGVGTVSLTLSQPRERSLQVKKVFVKGMKKERALGEGAAWWQSQRLVSPGKHDRVSTHRKSQSVFTGVSAGDKQFTTTFSIVFTI

SEQ ID NO: 47837 - protein, 296 aa, Homo sapiens
  Payload ID: 9673
  Gene Symbol: LYSMD4
  Gene Name: LysM, putative peptidoglycan-binding, domain containing 4
  Uniprot ID: Q5XG99
  ENSP ID: ENSP00000386283
MRHEELLTKTFQGPAVVCGTPTSHVYMFKNGSGDSGDSSEEESHRVVLRPRGKERHKSGVHQPPQAGAGDVVLLQRELAQEDSLNKLALQYGCKVADIKKVNNFIREQDLYALKSVKIPVRNHGILMETHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 47838 - protein, 123 aa, Homo sapiens
  Payload ID: 9673
  Gene Symbol: LYSMD4
  Gene Name: LysM, putative peptidoglycan-binding, domain containing 4
  ENSP ID: ENSP00000400054
MAVGTRGTLLKKSLTVWFCGPGARSATRAVSTSLPRREQVTWCCCSGSWPRRTASTSWRCSMAAKPNGAGDTRQNLIPDFYAFRVINNGKVADIKKVNNFIREQDLYALKSVKIPVRNHGILM

SEQ ID NO: 47839 - protein, 235 aa, Homo sapiens
  Payload ID: 9673
  Gene Symbol: LYSMD4
  Gene Name: LysM, putative peptidoglycan-binding, domain containing 4
  ENSP ID: ENSP00000445357
MFVANPQARWQLRVAGRGSRVAGRRSRRSLGAEVADIKKVNNFIREQDLYALKSVKIPVRNHGILMETHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 47840 - protein, 414 aa, Homo sapiens [sequence omitted]

SEQ ID NO: 47841 - protein, 376 aa, Homo sapiens
  Payload ID: 9674
  Gene Symbol: LCLAT1
  Gene Name: lysocardiolipin acyltransferase 1
  Uniprot ID: Q6UWP7
  ENSP ID: ENSP00000368823
MVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASLKGVPGFGWAMQAAAYIFIHRKWKDDKSHFEDMIDYFCDIHEPLQLLIFPEGTDLTENSKSRSNAFAEKNGLQKYEYVLHPRTTGFTFVVDRLREGKNLDAVHDITVAYPHNIPQSEKHLLQGDFPREIHFHVHRYPIDTLPTSKEDLQLWCHKRWEEKEERLRSFYQGEKNFYFTGQSVIPPCKSELRVLVVKLLSILYWTLFSPAMCLLIYLYSLVKWYFIITIVIFVLQERIFGGLEIIELACYRLLHKQPHLNSKKNE

SEQ ID NO: 47842 - protein, 308 aa, Homo sapiens
  Payload ID: 9674
  Gene Symbol: LCLAT1
  Gene Name: lysocardiolipin acyltransferase 1
  Uniprot ID: Q6UWP7
  ENSP ID: ENSP00000368826
MHSRGREIVVLLNPWSINEAVSSYCTYFIKQDSKSFGIMVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASLKGVPGFGWAMQAAAYIFIHRKWKDDKSHFEDMIDYFCDIHEPLQLLIFPEGTDLTENSKSRSNAFAEKNGLQKYEYVLHPRTTGFTFVVDRLREGRRQSEGSKGPLQGELQITAQGNQRGHKQMEKHSMLMDWKNQYREIGHTAQSNLQIQCYSH

SEQ ID NO: 47843 - protein, 123 aa, Homo sapiens
  Payload ID: 9674
  Gene Symbol: LCLAT1
  Gene Name: lysocardiolipin acyltransferase 1
  ENSP ID: ENSP00000417565
MVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASLKGVPGFGR

SEQ ID NO: 47844 - protein, 153 aa, Homo sapiens
  Payload ID: 9674
  Gene Symbol: LCLAT1
  Gene Name: lysocardiolipin acyltransferase 1
  ENSP ID: ENSP00000417875
MHSRGREIVVLLNPWSINEAVSSYCTYFIKQDSKSFGIMVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASL

SEQ ID NO: 47845 - protein, 105 aa, Homo sapiens
  Payload ID: 9674
  Gene Symbol: LCLAT1
  Gene Name: lysocardiolipin acyltransferase 1
  ENSP ID: ENSP00000417951
MVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLR

SEQ ID NO: 47846 - protein, 137 aa, Homo sapiens
  Payload ID: 9674
  Gene Symbol: LCLAT1
  Gene Name: lysocardiolipin acyltransferase 1
  ENSP ID: ENSP00000419444
MVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASLKGVPGFGWAMQAAAYIFIHRKW

SEQ ID NO: 47847 - protein, 157 aa, Homo sapiens
  Payload ID: 9674
  Gene Symbol: LCLAT1
  Gene Name: lysocardiolipin acyltransferase 1
  ENSP ID: ENSP00000419646
MVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASLKGVPGFENSKSRSNAFAEKNGLQKYEYVLHPRTTGFTFVVDR

SEQ ID NO: 47848 - protein, 66 aa, Homo sapiens
  Payload ID: 9674
  Gene Symbol: LCLAT1
  Gene Name: lysocardiolipin acyltransferase 1
  ENSP ID: ENSP00000419735
MHSRGREIVVLLNPWSINEAVSSYCTYFIKQDSKSFGHSTSLELSPDFHLCSDPPLHSILTGTQAL

SEQ ID NO: 47849 - protein, 140 aa, Homo sapiens
  Payload ID: 9674
  Gene Symbol: LCLAT1
  Gene Name: lysocardiolipin acyltransferase 1
  ENSP ID: ENSP00000419966
MVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASLKGVPGFAQSHLKPNDTGILQQDCCC

SEQ ID NO: 47850 - protein, 136 aa, Homo sapiens
  Payload ID: 9674
  Gene Symbol: LCLAT1
  Gene Name: lysocardiolipin acyltransferase 1
  ENSP ID: ENSP00000420481
MVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASLKGVPGFGWAMQAAAYIFIHRK

SEQ ID NO: 47851 - protein, 364 aa, Homo sapiens
  Payload ID: 9675
  Gene Symbol: LPAR1
  Gene Name: lysophosphatidic acid receptor 1
  Uniprot ID: Q92633
  ENSP ID: ENSP00000351755
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 47852 - protein, 364 aa, Homo sapiens; identical to SEQ ID NO: 47851
  Payload ID: 9675
  Gene Symbol: LPAR1
  Gene Name: lysophosphatidic acid receptor 1
  Uniprot ID: Q92633
  ENSP ID: ENSP00000363552

SEQ ID NO: 47853 - protein, 364 aa, Homo sapiens; identical to SEQ ID NO: 47851
  Payload ID: 9675
  Gene Symbol: LPAR1
  Gene Name: lysophosphatidic acid receptor 1
  Uniprot ID: Q92633
  ENSP ID: ENSP00000363553

SEQ ID NO: 47854 - protein, 182 aa, Homo sapiens
  Payload ID: 9675
  Gene Symbol: LPAR1
  Gene Name: lysophosphatidic acid receptor 1
  ENSP ID: ENSP00000401810
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIP

SEQ ID NO: 47855 - protein, 346 aa, Homo sapiens
  Payload ID: 9675
  Gene Symbol: LPAR1
  Gene Name: lysophosphatidic acid receptor 1
  ENSP ID: ENSP00000445697
MNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 47856 - protein, 351 aa, Homo sapiens
  Payload ID: 9676
  Gene Symbol: LPAR2
  Gene Name: lysophosphatidic acid receptor 2
  Uniprot ID: Q9HBW0
  ENSP ID: ENSP00000384665
MVIMGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDAEMRRTFRRLLCCACLRQSTRESVHYTSSAQGGASTRIMLPENGHPLMDSTL

SEQ ID NO: 47857 - protein, 351 aa, Homo sapiens; identical to SEQ ID NO: 47856
  Payload ID: 9676
  Gene Symbol: LPAR2
  Gene Name: lysophosphatidic acid receptor 2
  Uniprot ID: Q9HBW0
  ENSP ID: ENSP00000443256

SEQ ID NO: 47858 - protein, 25 aa, Homo sapiens
  Payload ID: 9676
  Gene Symbol: LPAR2
  Gene Name: lysophosphatidic acid receptor 2
  ENSP ID: ENSP00000465206
MVIMGQCYYNETIGFFYNNSGKELS

SEQ ID NO: 47859 - protein, 351 aa, Homo sapiens; identical to SEQ ID NO: 47856
  Payload ID: 9676
  Gene Symbol: LPAR2
  Gene Name: lysophosphatidic acid receptor 2
  Uniprot ID: Q9HBW0
  ENSP ID: ENSP00000465280

SEQ ID NO: 47860 - protein, 74 aa, Homo sapiens
  Payload ID: 9676
  Gene Symbol: LPAR2
  Gene Name: lysophosphatidic acid receptor 2
  ENSP ID: ENSP00000466112
MVIMGQCYYNETIGFFYNNSGKELSSHWRPKDVVVVALGLTVSVLVLLTNLLVIAAIASNRRFHQPIYYLLGNL

SEQ ID NO: 47861 - protein, 20 aa, Homo sapiens
  Payload ID: 9676
  Gene Symbol: LPAR2
  Gene Name: lysophosphatidic acid receptor 2
  ENSP ID: ENSP00000466940
MVIMGQCYYNETIGFFYNNS

SEQ ID NO: 47862 - protein, 80 aa, Homo sapiens
  Payload ID: 9676
  Gene Symbol: LPAR2
  Gene Name: lysophosphatidic acid receptor 2
  ENSP ID: ENSP00000468132
MVIMGQCYYNETIGFFYNNSGKELSSHWRPKDVVVVALGLTVSVLVLLTNLLVIAAIASNRRFHQPIYYLLGNLAAADLF

SEQ ID NO: 47863 - protein, 353 aa, Homo sapiens
  Payload ID: 9677
  Gene Symbol: LPAR3
  Gene Name: lysophosphatidic acid receptor 3
  Uniprot ID: Q9UBY5
  ENSP ID: ENSP00000359643
MNECHYDKHMDFFYNRSNTDTVDDWTGTKLVIVLCVGTFFCLFIFFSNSLVIAAVIKNRKFHFPFYYLLANLAAADFFAGIAYVFLMFNTGPVSKTLTVNRWFLRQGLLDSSLTASLTNLLVIAVERHMSIMRMRVHSNLTKKRVTLLILLVWAIAIFMGAVPTLGWNCLCNISACSSLAPIYSRSYLVFWTVSNLMAFLIMVVVYLRIYVYVKRKTNVLSPHTSGSISRRRTPMKLMKTVMTVLGAFVVCWTPGLVVLLLDGLNCRQCGVQHVKRWFLLLALLNSVVNPIIYSYKDEDMYGTMKKMICCFSQENPERRPSRIPSTVLSRSDTGSQYIEDSISQGAVCNKSTS

SEQ ID NO: 47864 - protein, 353 aa, Homo sapiens; identical to SEQ ID NO: 47863
  Payload ID: 9677
  Gene Symbol: LPAR3
  Gene Name: lysophosphatidic acid receptor 3
  Uniprot ID: Q9UBY5
  ENSP ID: ENSP00000395389

SEQ ID NO: 47865 - protein, 370 aa, Homo sapiens
  Payload ID: 9678
  Gene Symbol: LPAR4
  Gene Name: lysophosphatidic acid receptor 4
  Uniprot ID: Q99677
  ENSP ID: ENSP00000408205
MGDRRFIDFQFQDSNSSLRPRLGNATANNTCIVDDSFKYNLNGAVYSVVFILGLITNSVSLFVFCFRMKMRSETAIFITNLAVSDLLFVCTLPFKIFYNFNRHWPFGDTLCKISGTAFLTNIYGSMLFLTCISVDRFLAIVYPFRSRTIRTRRNSAIVCAGVWILVLSGGISASLFSTTNVNNATTTCFEGFSKRVWKTYLSKITIFIEVVGFIIPLILNVSCSSVVLRTLRKPATLSQIGTNKKKVLKMITVHMAVFVVCFVPYNSVLFLYALVRSQAITNCFLERFAKIMYPITLCLATLNCCFDPFIYYFTLESFQKSFYINAHIRMESLFKTETPLTTKPSLPAIQEEVSDQTTNNGGELMLESTF

SEQ ID NO: 47866 - protein, 45 aa, Homo sapiens
  Payload ID: 9678
  Gene Symbol: LPAR4
  Gene Name: lysophosphatidic acid receptor 4
  ENSP ID: ENSP00000476460
MGDRRFIDFQFQDSNSSLRPRLGNATANNTCIVDDSFKYNLNGAV

SEQ ID NO: 47867 - protein, 370 aa, Homo sapiens; identical to SEQ ID NO: 47865
  Payload ID: 9678
  Gene Symbol: LPAR4
  Gene Name: lysophosphatidic acid receptor 4
  Uniprot ID: Q99677
  ENSP ID: ENSP00000478261

SEQ ID NO: 47868 - protein, 372 aa, Homo sapiens [sequence omitted]

SEQ ID NO: 47869 - protein, 372 aa, Homo sapiens [sequence omitted]

SEQ ID NO: 47870 - protein, 344 aa, Homo sapiens
  Payload ID: 9680
  Gene Symbol: LPAR6
  Gene Name: lysophosphatidic acid receptor 6
  Uniprot ID: P43657
  ENSP ID: ENSP00000344353
MVSVNSSHCFYNDSFKYTLYGCMFSMVFVLGLISNCVAIYIFICVLKVRNETTTYMINLAMSDLLFVFTLPFRIFYFTTRNWPFGDLLCKISVMLFYTNMYGSILFLTCISVDRFLAIVYPFKSKTLRTKRNAKIVCTGVWLTVIGGSAPAVFVQSTHSQGNNASEACFENFPEATWKTYLSRIVIFIEIVGFFIPLILNVTCSSMVLKTLTKPVTLSRSKINKTKVLKMIFVHLIIFCFCFVPYNINLILYSLVRTQTFVNCSVVAAVRTMYPITLCIAVSNCCFDPIVYYFTSDTIQNSIKMKNWSVRRSDFRFSEVHGAENFIQHNLQTLKSKIFDNESAA

SEQ ID NO: 47871 - protein, 344 aa, Homo sapiens; identical to SEQ ID NO: 47870
  Payload ID: 9680
  Gene Symbol: LPAR6
  Gene Name: lysophosphatidic acid receptor 6
  Uniprot ID: P43657
  ENSP ID: ENSP00000367691

SEQ ID NO: 47872 - protein, 344 aa, Homo sapiens; identical to SEQ ID NO: 47870
  Payload ID: 9680
  Gene Symbol: LPAR6
  Gene Name: lysophosphatidic acid receptor 6
  Uniprot ID: P43657
  ENSP ID: ENSP00000482660

SEQ ID NO: 47873 - protein, 534 aa, Homo sapiens
  Payload ID: 9681
  Gene Symbol: LPCAT1
  Gene Name: lysophosphatidylcholine acyltransferase 1
  Uniprot ID: Q8NF37
  ENSP ID: ENSP00000283415
MRLRGCGPRAAPASSAGASDARLLAPPGRNPFVHELRLSALQKAQVALMTLTLFPVRLLVAAAMMLLAWPLALVASLGSAEKEPEQPPALWRKVVDFLLKAIMRTMWFAGGFHRVAVKGRQALPTEAAILTLAPHSSYFDAIPVTMTMSSIVMKAESRDIPIWGTLIQYIRPVFVSRSDQDSRRKTVEEIKRRAQSNGKWPQIMIFPEGTCTNRTCLITFKPGAFIPGAPVQPVVLRYPNKLDTITWTWQGPGALEILWLTLCQFHNQVEIEFLPVYSPSEEEKRNPALYASNVRRVMAEALGVSVTDYTFEDCQLALAEGQLRLPADTCLLEFARLVRGLGLKPEKLEKDLDRYSERARMKGGEKIGIAEFAASLEVPVSDLLEDMFSLFDESGSGEVDLRECVVALSVVCRPARTLDTIQLAFKMYGAQEDGSVGEGDLSCILKTALGVAELTVTDLFRAIDQEEKGKITFADFHRFAEMYPAFAEEYLYPDQTHFESCAETSPAPIPNGFCADFSPENSDAGRKPVRKKLD

SEQ ID NO: 47874 - protein, 534 aa, Homo sapiens; identical to SEQ ID NO: 47873
  Payload ID: 9681
  Gene Symbol: LPCAT1
  Gene Name: lysophosphatidylcholine acyltransferase 1
  Uniprot ID: Q8NF37
  ENSP ID: ENSP00000423472

SEQ ID NO: 47875 - protein, 489 aa, Homo sapiens
  Payload ID: 9681
  Gene Symbol: LPCAT1
  Gene Name: lysophosphatidylcholine acyltransferase 1
  ENSP ID: ENSP00000485019
VALMTLTLFPVRLLVAAAMMLLAWPLALVASLGSAEKEPEQPPALWRKVVDFLLKAIMRTMWFAGGFHRVAVKGRQALPTEAAILTLAPHSSYFDAIPVTMTMSSIVMKAESRDIPIWGTLIQYIRPVFVSRSDQDSRRKTVEEIKRRAQSNGKWPQIMIFPEGTCTNRTCLITFKPGAFIPGAPVQPVVLRYPNKLDTITWTWQGPGALEILWLTLCQFHNQVEIEFLPVYSPSEEEKRNPALYASNVRRVMAEALGVSVTDYTFEDCQLALAEGQLRLPADTCLLEFARLVRGLGLKPEKLEKDLDRYSERARMKGGEKIGIAEFAASLEVPVSDLLEDMFSLFDESGSGEVDLRECVVALSVVCRPARTLDTIQLAFKMYGAQEDGSVGEGDLSCILKTALGVAELTVTDLFRAIDQEEKGKITFADFHRFAEMYPAFAEEYLYPDQTHFESCAETSPAPIPNGFCADFSPENSDAGRKPVRKKLD

SEQ ID NO: 47876 - protein, 489 aa, Homo sapiens; identical to SEQ ID NO: 47875
  Payload ID: 9681
  Gene Symbol: LPCAT1
  Gene Name: lysophosphatidylcholine acyltransferase 1
  ENSP ID: ENSP00000485860

SEQ ID NO: 47877 - protein, 234 aa, Homo sapiens
  Payload ID: 9681
  Gene Symbol: LPCAT1
  Gene Name: lysophosphatidylcholine acyltransferase 1
  ENSP ID: ENSP00000486797
ALGVSVTDYTFEDCQLALAEGQLRLPADTCLLEFARLVRGLGLKPEKLEKDLDRYSERARMKGGEKIGIAEFAASLEVPVSDLLEDMFSLFDESGSGEVDLRECVVALSVVCRPARTLDTIQLAFKMYGAQEDGSVGEGDLSCILKTALGVAELTVTDLFRAIDQEEKGKITFADFHRFAEMYPAFAEEYLYPDQTHFESCAETSPAPIPNGFCADFSPENSDAGRKPVRKKLD

SEQ ID NO: 47878 - protein, 544 aa, Homo sapiens
  Payload ID: 9682
  Gene Symbol: LPCAT2
  Gene Name: lysophosphatidylcholine acyltransferase 2
  Uniprot ID: Q7L5N7
  ENSP ID: ENSP00000262134
MSRCAQAAEVAATVPGAGVGNVGLRPPMVPRQASFFPPPVPNPFVQQTQIGSARRVQIVLLGIILLPIRVLLVALILLLAWPFAAISTVCCPEKLTHPITGWRRKITQTALKFLGRAMFFSMGFIVAVKGKIASPLEAPVFVAAPHSTFFDGIACVVAGLPSMVSRNENAQVPLIGRLLRAVQPVLVSRVDPDSRKNTINEIIKRTTSGGEWPQILVFPEGTCTNRSCLITFKPGAFIPGVPVQPVLLRYPNKLDTVTWTWQGYTFIQLCMLTFCQLFTKVEVEFMPVQVPNDEEKNDPVLFANKVRNLMAEALGIPVTDHTYEDCRLMISAGQLTLPMEAGLVEFTKISRKLKLDWDGVRKHLDEYASIASSSKGGRIGIEEFAKYLKLPVSDVLRQLFALFDRNHDGSIDFREYVIGLAVLCNPSNTEEIIQVAFKLFDVDEDGYITEEEFSTILQASLGVPDLDVSGLFKEIAQGDSISYEEFKSFALKHPEYAKIFTTYLDLQTCHVFSLPKEVQTTPSTASNKVSPEKHEESTSDKKDD

SEQ ID NO: 47879 - protein, 188 aa, Homo sapiens
  Payload ID: 9682
  Gene Symbol: LPCAT2
  Gene Name: lysophosphatidylcholine acyltransferase 2
  ENSP ID: ENSP00000457496
  MOD_RES (1)..(1): Any amino acid
XAPHSTFFDGIACVVAGLPSMVSRNENAQVPLIGRLLRAVQPVLVSRVDPDSRKNTINEIIKRTTSGGEWPQILVFPEGTCTNRSCLITFKPGAFIPGVPVQPVLLRYPNKLDTVTWTWQGYTFIQLCMLTFCQLFTKVEVEMFLFFWEGSSKHCLKISSFFCIFSLRRFKRRITQRTRTAHLLRLSF

SEQ ID NO: 47880 - protein, 252 aa, Homo sapiens
  Payload ID: 9682
  Gene Symbol: LPCAT2
  Gene Name: lysophosphatidylcholine acyltransferase 2
  ENSP ID: ENSP00000483225
MMKKNDPVLFANKVRNLMAEALGIPVTDHTYEDCRLMISAGQLTLPMEAGLVEFTKISRKLKLDWDGVRKHLDEYASIASSSKGGRIGIEEFAKYLKLPVSDVLRQLFALFDRNHDGSIDFREYVIGLAVLCNPSNTEEIIQVAFKLFDVDEDGYITEEEFSTILQASLGVPDLDVSGLFKEIAQGDSISYEEFKSFALKHPEYAKIFTTYLDLQTCHVFSLPKEVQTTPSTASNKVSPEKHEESTSDKKDD

SEQ ID NO: 47881 - protein, 487 aa, Homo sapiens
  Payload ID: 9683
  Gene Symbol: LPCAT3
  Gene Name: lysophosphatidylcholine acyltransferase 3
  Uniprot ID: Q6P1A2
  ENSP ID: ENSP00000261407
MASSAEGDEGTVVALAGVLQSGFQELSLNKLATSLGASEQALRLIISIFLGYPFALFYRHYLFYKETYLIHLFHTFTGLSIAYFNFGNQLYHSLLCIVLQFLILRLMGRTITAVLTTFCFQMAYLLAGYYYTATGNYDIKWTMPHCVLTLKLIGLAVDYFDGGKDQNSLSSEQQKYAIRGVPSLLEVAGFSYFYGAFLVGPQFSMNHYMKLVQGELIDIPGKIPNSIIPALKRLSLGLFYLVGYTLLSPHITEDYLLTEDYDNHPFWFRCMYMLIWGKFVLYKYVTCWLVTEGVCILTGLGFNGFEEKGKAKWDACANMKVWLFETNPRFTGTIASFNINTNAWVARYIFKRLKFLGNKELSQGLSLLFLALWHGLHSGYLVCFQMEFLIVIVERQAARLIQESPTLSKLAAITVLQPFYYLVQQTIHWLFMGYSMTAFCLFTWDKWLKVYKSIYFLGHIFFLSLLFILPYIHKAMVPRKEKLKKME

SEQ ID NO: 47882 - protein, 64 aa, Homo sapiens
  Payload ID: 9683
  Gene Symbol: LPCAT3
  Gene Name: lysophosphatidylcholine acyltransferase 3
  ENSP ID: ENSP00000437827
MASSAEGDEGTVVALAGVLQSGFQELSLNKLATSLGASEQALRLIISIFLGTPWMKPLPAEFWQ

SEQ ID NO: 47883 - protein, 347 aa, Homo sapiens
  Payload ID: 9683
  Gene Symbol: LPCAT3
  Gene Name: lysophosphatidylcholine acyltransferase 3
  ENSP ID: ENSP00000438765
MASSAEGDEGTVVALAGVLQSGFQELSLNKLATSLGASEQALRLIISIFLGYPFALFYRHYLFYKETYLIHLFHTFTGLSIAYFNFGNQLYHSLLCIVLQFLILRLMGRTITAVLTTFCFQMAYLLAGYYYTATGNYDIKWTMPHCVLTLKLIGLAVDYFDGGKDQNSLSSEQQKYAIRGVPSLLEVAGFSYFYGAFLVGPQFSMNHYMKLVQGELIDIPGKIPNSIIPALKRLSLGLFYLVGYTLLSPHITEDYLLTEDYDNHPFWFRCMYMLIWGKFVLYKYVTCWLVTEGVCILTGLGFNGFEEKGKAKWDACANMKVWLFETNPRFTGTIASFNINTNAWVAR

SEQ ID NO: 47884 - protein, 198 aa, Homo sapiens
  Payload ID: 9683
  Gene Symbol: LPCAT3
  Gene Name: lysophosphatidylcholine acyltransferase 3
  ENSP ID: ENSP00000440550
MASSAEGDEGTVVALAGVLQSGFQELSLNKLATSLGASEQALRLIISIFLGYPFALFYRHYLFYKETYLIHLFHTFTGLSIAYFNFGNQLYHSLLCIVLQFLILRLMGRTITAVLTTFCFQMAYLLAGYYYTATGNYDIKWTMPHCVLTLKLIGLAVDYFDGGKDQHHSCSQAPESGPFLPSGLHTAQPPHHRRLSPH

SEQ ID NO: 47885 - protein, 85 aa, Homo sapiens
  Payload ID: 9683
  Gene Symbol: LPCAT3
  Gene Name: lysophosphatidylcholine acyltransferase 3
  ENSP ID: ENSP00000442454
MASSAEGDEGTVVALAGVLQSGFQELSLNKLATSLGASEQALRLIISIFLGLPSGWILLHCHRQLRYQVDNATLCSDFEADWFGC

SEQ ID NO: 47886 - protein, 158 aa, Homo sapiens
  Payload ID: 9683
  Gene Symbol: LPCAT3
  Gene Name: lysophosphatidylcholine acyltransferase 3
  ENSP ID: ENSP00000443166
MASSAEGDEGTVVALAGVLQSGFQELSLNKLATSLGASEQALRLIISIFLGYPFALFYRHYLFYKETYLIHLFHTFTGLSIAYFNFGNQLYHSLLCIVLQFLILRLMGRTITAVLTTFCFQMAYLLAGYYYTATGNYDIKWTMPHCVLTLKLIEFLVL

SEQ ID NO: 47887 - protein, 524 aa, Homo sapiens
  Payload ID: 9684
  Gene Symbol: LPCAT4
  Gene Name: lysophosphatidylcholine acyltransferase 4
  Uniprot ID: Q643R3
  ENSP ID: ENSP00000317300
MSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFELFAEEQAEGPNRLLYKDGFSTILHLLLGSPHPAATALHAELCQAGSSQGLSLCQFQNFSLHDPLYGKLFSTYLRPPHTSRGTSQTPNASSPGNPTALANGTVQAPKQKGD

SEQ ID NO: 47888 - protein, 84 aa, Homo sapiens
  Payload ID: 9684
  Gene Symbol: LPCAT4
  Gene Name: lysophosphatidylcholine acyltransferase 4
  ENSP ID: ENSP00000454422
FLPVYHPSPEESRDPTLYANNVQRVMAQALGIPATECEFVGSLPVIVVGRLKVALEPQLWELGKVLRKAGIPRVWWTSEMWPLH

SEQ ID NO: 47889 - protein, 351 aa, Homo sapiens
  Payload ID: 9684
  Gene Symbol: LPCAT4
  Gene Name: lysophosphatidylcholine acyltransferase 4
  ENSP ID: ENSP00000478003
MTRLLDAEWWRRSEAGHLRRQVAAVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFELFAEEQAEGPNRLLYKDGFSTILHLLLGSPHPAATALHAELCQAGSSQGLSLCQFQNFSLHDPLYGKLFSTYLRPPHTSRGTSQTPNASSPGNPTALANGTVQAPKQKGD

SEQ ID NO: 47890 - protein, 370 aa, Homo sapiens
  Payload ID: 9685
  Gene Symbol: LPGAT1
  Gene Name: lysophosphatidylglycerol acyltransferase 1
  Uniprot ID: Q92604
  ENSP ID: ENSP00000355963
MAITLEEAPWLGWLLVKALMRFAFMVVNNLVAIPSYICYVIILQPLRVLDSKRFWYIEGIMYKWLLGMVASWGWYAGYTVMEWGEDIKAVSKDEAVMLVNHQATGDVCTLMMCLQDKGLVVAQMMWLMDHIFKYTNFGIVSLVHGDFFIRQGRSYRDQQLLLLKKHLENNYRSRDRKWIVLFPEGGFLRKRRETSQAFAKKNNLPFLTNVTLPRSGATKIILNALVAQQKNGSPAGGDAKELDSKSKGLQWIIDTTIAYPKAEPIDIQTWILGYRKPTVTHVHYRIFPIKDVPLETDDLTTWLYQRFVEKEDLLSHFYETGAFPPSKGHKEAVSREMTLSNLWIFLIQSFAFLSGYMWYNIIQYFYHCLF

SEQ ID NO: 47891 - protein, 370 aa, Homo sapiens; identical to SEQ ID NO: 47890
  Payload ID: 9685
  Gene Symbol: LPGAT1
  Gene Name: lysophosphatidylglycerol acyltransferase 1
  Uniprot ID: Q92604
  ENSP ID: ENSP00000355964

SEQ ID NO: 47892 - protein, 230 aa, Homo sapiens
  Payload ID: 9686
  Gene Symbol: LYPLA1
  Gene Name: lysophospholipase I
  Uniprot ID: O75608
  ENSP ID: ENSP00000320043
MCGNNMSTPLPAIVPAARKATAAVIFLHGLGDTGHGWAEAFAGIRSSHIKYICPHAPVRPVTLNMNVAMPSWFDIIGLSPDSQEDESGIKQAAENIKALIDQEVKNGIPSNRIILGGFSQGGALSLYTALTTQQKLAGVTALSCWLPLRASFPQGPIGGANRDISILQCHGDCDPLVPLMFGSLTVEKLKTLVNPANVTFKTYEGMMHSSCQQEMMDVKQFIDKLLPPID

SEQ ID NO: 47893 - protein, 214 aa, Homo sapiens
  Payload ID: 9686
  Gene Symbol: LYPLA1
  Gene Name: lysophospholipase I
  Uniprot ID: O75608
  ENSP ID: ENSP00000344477
MCGNNMSTPLPAIVPAARKATAAVIFLHGLGDTGHGWAEAFAGIRSSHIKYICPHAFDIIGLSPDSQEDESGIKQAAENIKALIDQEVKNGIPSNRIILGGFSQGGALSLYTALTTQQKLAGVTALSCWLPLRASFPQGPIGGANRDISILQCHGDCDPLVPLMFGSLTVEKLKTLVNPANVTFKTYEGMMHSSCQQEMMDVKQFIDKLLPPID

SEQ ID NO: 47894 - protein, 58 aa, Homo sapiens
  Payload ID: 9686
  Gene Symbol: LYPLA1
  Gene Name: lysophospholipase I
  ENSP ID: ENSP00000427967
MCGNNMSTPLPAIVPAARKATAAVIFLHGLGDTGVLSVVLIEIFLFSSATGIVTLWFP

SEQ ID NO: 47895 - protein, 90 aa, Homo sapiens
  Payload ID: 9686
  Gene Symbol: LYPLA1
  Gene Name: lysophospholipase I
  ENSP ID: ENSP00000428306
MNVAMPSWFDIIGLSPDSQEDESGIKQAAENIKALIDQEVKNGIPSNRIILGGFSQGGALSLYTALTTQQKLAGVTALSCWLPLRASFPQ

SEQ ID NO: 47896 - protein, 197 aa, Homo sapiens
  Payload ID: 9686
  Gene Symbol: LYPLA1
  Gene Name: lysophospholipase I
  ENSP ID: ENSP00000428729
MCGNNMSTPLPAIVPAARKATAAVIFLHGLGDTGHGWAEAFAGIRSSHIKYICPHAFDIIGLSPDSQEDESGIKQAAENIKALIDQEVKNGIPSNRIILGGFSQGGALSLYTALTTQQKLAGVTALSCWLPLRASFPQGPIGGANRDISILQCHGDCDPLVPLMFGSLTVEKLKTLVNPANVTFKTYEGMMHSSCQQ

SEQ ID NO: 47897 - protein, 103 aa, Homo sapiens
  Payload ID: 9686
  Gene Symbol: LYPLA1
  Gene Name: lysophospholipase I
  ENSP ID: ENSP00000430791
MCGNNMSTPLPAIVPAARKATAAVIFLHGLGDTGPVRPVTLNMNVAMPSWFDIIGLSPDSQEDESGIKQAAENIKALIDQEVKNGIPSNRIILGGFSQGGALS

SEQ ID NO: 47898 - protein, 196 aa, Homo sapiens
  Payload ID: 9686
  Gene Symbol: LYPLA1
  Gene Name: lysophospholipase I
  ENSP ID: ENSP00000482430
MCGNNMSTPLPAIVPAARKATAAVIFLHGLGDTGHGWAEAFAGIRSSHIKYICPHAPVRPVTLNMNVAMPSWFDIIGLSPDSQEDESGIKQAAENIKALIDQEVKNGIPSNRIILGGFSQGPIGGANRDISILQCHGDCDPLVPLMFGSLTVEKLKTLVNPANVTFKTYEGMMHSSCQQEMMDVKQFIDKLLPPID

SEQ ID NO: 47899 - protein, 166 aa, Homo sapiens
  Payload ID: 9686
  Gene Symbol: LYPLA1
  Gene Name: lysophospholipase I
  ENSP ID: ENSP00000484280
MNVAMPSWFDIIGLSPDSQEDESGIKQAAENIKALIDQEVKNGIPSNRIILGGFSQGGALSLYTALTTQQKLAGVTALSCWLPLRASFPQGPIGGANRDISILQCHGDCDPLVPLMFGSLTVEKLKTLVNPANVTFKTYEGMMHSSCQQEMMDVKQFIDKLLPPID

SEQ ID NO: 47900 - protein, 164 aa, Homo sapiens
  Payload ID: 9687
  Gene Symbol: LYPLA2
  Gene Name: lysophospholipase II
  ENSP ID: ENSP00000363625
MKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 47901 - protein, 180 aa, Homo sapiens
  Payload ID: 9687
  Gene Symbol: LYPLA2
  Gene Name: lysophospholipase II
  ENSP ID: ENSP00000363626
MCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQVNVPTDPPALCVCILVAWGLLQH

SEQ ID NO: 47902 - protein, 182 aa, Homo sapiens
  Payload ID: 9687
  Gene Symbol: LYPLA2
  Gene Name: lysophospholipase II
  ENSP ID: ENSP00000363627
MCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQGPVQDIPGCHAQLLSSGDGSCEGIS

SEQ ID NO: 47903 - protein, 137 aa, Homo sapiens
  Payload ID: 9687
  Gene Symbol: LYPLA2
  Gene Name: lysophospholipase II
  ENSP ID: ENSP00000363629
MCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENRRGPVPLHGPHLPPPSGWHRGVELLAASAPGLPPGECPH

SEQ ID NO: 47904 - protein, 231 aa, Homo sapiens
  Payload ID: 9687
  Gene Symbol: LYPLA2
  Gene Name: lysophospholipase II
  Uniprot ID: O95372
  ENSP ID: ENSP00000363638
MCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 47905 - protein, 90 aa, Homo sapiens
  Payload ID: 9687
  Gene Symbol: LYPLA2
  Gene Name: lysophospholipase II
  ENSP ID: ENSP00000388003
MCGNTMSVPLLTDAATVSGAERETAAVIFLHGLGDTGHSWADALSTIRLPHVKYICPHAPRIPVTLNMKMVMPSWFDLMGLSPDAPEDEA

SEQ ID NO: 47906 - protein, 162 aa, Homo sapiens
  Payload ID: 9687
  Gene Symbol: LYPLA2
  Gene Name: lysophospholipase II
  ENSP ID: ENSP00000409004
MLPPCLELSGKRPRHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGA

SEQ ID NO: 47907 - protein, 221 aa, Homo sapiens
  Payload ID: 9688
  Gene Symbol: LYPLAL1
  Gene Name: lysophospholipase-like 1
  Uniprot ID: Q5VWZ2
  ENSP ID: ENSP00000355894
MAAASGSVLQRCIVSPAGRHSASLIFLHGSGDSGQGLRMWIKQVLNQDLTFQHIKIIYPTAPPRFKITNDCPEHLESIDVMCQVLTDLIDEEVKSGIKKNRILIGGFSMGGCMAIHLAYRNHQDVAGVFALSSFLNKASAVYQALQKSNGVLPELFQCHGTADELVLHSWAEETNSMLKSLGVTTKFHSFPNVYHELSKTELDILKLWILTKLPGEMEKQK

SEQ ID NO: 47908 - protein, 237 aa, Homo sapiens
  Payload ID: 9688
  Gene Symbol: LYPLAL1
  Gene Name: lysophospholipase-like 1
  Uniprot ID: Q5VWZ2
  ENSP ID: ENSP00000355895
MAAASGSVLQRCIVSPAGRHSASLIFLHGSGDSGQGLRMWIKQVLNQDLTFQHIKIIYPTAPPRSYTPMKGGISNVWFDRFKITNDCPEHLESIDVMCQVLTDLIDEEVKSGIKKNRILIGGFSMGGCMAIHLAYRNHQDVAGVFALSSFLNKASAVYQALQKSNGVLPELFQCHGTADELVLHSWAEETNSMLKSLGVTTKFHSFPNVYHELSKTELDILKLWILTKLPGEMEKQK

SEQ ID NO: 47909 - protein, 233 aa, Homo sapiens
  Payload ID: 9689
  Gene Symbol: LAPTM4A
  Gene Name: lysosomal protein transmembrane 4 alpha
  Uniprot ID: Q15012
  ENSP ID: ENSP00000175091
MVSMSFKRNRSDRFYSTRCCGCCHVRTGTIILGTWYMVVNLLMAILLTVEVTHPNSMPAVNIQYEVIGNYYSSERMADNACVLFAVSVLMFIISSMLVYGAISYQVGWLIPFFCYRLFDFVLSCLVAISSLTYLPRIKEYLDQLPDFPYKDDLLALDSSCLLFIVLVFFALFIIFKAYLINCVWNCYKYINNRNVPEIAVYPAFEAPPQYVLPTYEMAVKMPEKEPPPPYLPA

SEQ ID NO: 47910 - protein, 317 aa, Homo sapiens
  Payload ID: 9690
  Gene Symbol: LAPTM4B
  Gene Name: lysosomal protein transmembrane 4 beta
  Uniprot ID: Q86VI4
  ENSP ID: ENSP00000402301
MTSRTRVTWPSPPRPLPVPAAAAVAFGAKGTDPAEARSSRGIEEAGPRAHGRAGREPERRRSRQQRRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 47911 - protein, 226 aa, Homo sapiens
  Payload ID: 9690
  Gene Symbol: LAPTM4B
  Gene Name: lysosomal protein transmembrane 4 beta
  Uniprot ID: Q86VI4
  ENSP ID: ENSP00000428409
MKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 47912 - protein, 152 aa, Homo sapiens
  Payload ID: 9690
  Gene Symbol: LAPTM4B
  Gene Name: lysosomal protein transmembrane 4 beta
  ENSP ID: ENSP00000429868
MKMVAPWTRFYSNSCCLCCHVRTGTILLGVWYLIINAVVLLILLSALADPDQYNFSSSELGGDFEFMDDAKILFNLSADMCIAIAISLLMILICAMATYGAYKQRAAWIIPFFCYQIFDFALNMLVAITVLIYPNSIQEYIRQLPPNFPYRD

SEQ ID NO: 47913 - protein, 317 aa, Homo sapiens; identical to SEQ ID NO: 47910
  Payload ID: 9690
  Gene Symbol: LAPTM4B
  Gene Name: lysosomal protein transmembrane 4 beta
  Uniprot ID: Q86VI4
  ENSP ID: ENSP00000482533

SEQ ID NO: 47914 - protein, 262 aa, Homo sapiens
  Payload ID: 9691
  Gene Symbol: LAPTM5
  Gene Name: lysosomal protein transmembrane 5
  Uniprot ID: Q13571
  ENSP ID: ENSP00000294507
MDPRLSTVRQTCCCFNVRIATTALAIYHVIMSVLLFIEHSVEVAHGKASCKLSQMGYLRIADLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMNYLPSQEDMPHNQFIKMMIIFSIAFITVLIFKVYMFKCVWRCYRLIKCMNSVEEKRNSKMLQKVVLPSYEEALSLPSKTPEGGPAPPPYSEV

SEQ ID NO: 47915 - protein, 3801 aa, Homo sapiens
  Payload ID: 9692
  Gene Symbol: LYST
  Gene Name: lysosomal trafficking regulator
  Uniprot ID: Q99698
  ENSP ID: ENSP00000374443
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKTLLEGCCGEDIIYMNENGEFKLDVDSNAIIQDVKLLEELLLDWKIWSKAEQGVWETLLAALEVLIRADHHQQMFNIKQLLKAQVVHHFLLTCQVLQEYKEGQLTPMPREVCRSFVKIIAEVLGSPPDLELLTIIFNFLLAVHPPTNTYVCHNPTNFYFSLHIDGKIFQEKVRSIMYLRHSSSGGRSLMSPGFMVISPSGFTASPYEGENSSNIIPQQMAAHMLRSRSLPAFPTSSLLTQSQKLTGSLGCSIDRLQNIADTYVATQSKKQNSLGSSDTLKKGKEDAFISSCESAKTVCEMEAVLSAQVSVSDVPKGVLGFPVVKADHKQLGAEPRSEDDSPGDESCPRRPDYLKGLASFQRSHSTIASLGLAFPSQNGSAAVGRWPSLVDRNTDDWENFAYSLGYEPNYNRTASAHSVTEDCLVPICCGLYELLSGVLLILPDVLLEDVMDKLIQADTLLVLVNHPSPAIQQGVIKLLDAYFARASKEQKDKFLKNRGFSLLANQLYLHRGTQELLECFIEMFFGRHIGLDEEFDLEDVRNMGLFQKWSVIPILGLIETSLYDNILLHNALLLLLQILNSCSKVADMLLDNGLLYVLCNTVAALNGLEKNIPMSEYKLLACDIQQLFIAVTIHACSSSGSQYFRVIEDLIVMLGYLQNSKNKRTQNMAVALQLRVLQAAMEFIRTTANHDSENLTDSLQSPSAPHHAVVQKRKSIAGPRKFPLAQTESLLMKMRSVANDELHVMMQRRMSQENPSQATETELAQRLQRLTVLAVNRIIYQEFNSDIIDILRTPENVTQSKTSVFQTEISEENIHHEQSSVFNPFQKEIFTYLVEGFKVSIGSSKASGSKQQWTKILWSCKETFRMQLGRLLVHILSPAHAAQERKQIFEIVHEPNHQEILRDCLSPSLQHGAKLVLYLSELIHNHQGELTEEELGTAELLMNALKLCGHKCIPPSASTKADLIKMIKEEQKKYETEEGVNKAAWQKTVNNNQQSLFQRLDSKSKDISKIAADITQAVSLSQGNERKKVIQHIRGMYKVDLSASRHWQELIQQLTHDRAVWYDPIYYPTSWQLDPTEGPNRERRRLQRCYLTIPNKYLLRDRQKSEDVVKPPLSYLFEDKTHSSFSSTVKDKAASESIRVNRRCISVAPSRETAGELLLGKCGMYFVEDNASDTVESSSLQGELEPASFSWTYEEIKEVHKRWWQLRDNAVEIFLTNGRTLLLAFDNTKVRDDVYHNILTNNLPNLLEYGNITALTNLWYTGQITNFEYLTHLNKHAGRSFNDLMQYPVFPFILADYVSETLDLNDLLIYRNLSKPIAVQYKEKEDRYVDTYKYLEEEYRKGAREDDPMPPVQPYHYGSHYSNSGTVLHFLVRMPPFTKMFLAYQDQSFDIPDRTFHSTNTTWRLSSFESMTDVKELIPEFFYLPEFLVNREGFDFGVRQNGERVNHVNLPPWARNDPRLFILIHRQALESDYVSQNICQWIDLVFGYKQKGKASVQAINVFHPATYFGMDVSAVEDPVQRRALETMIKTYGQTPRQLFHMAHVSRPGAKLNIEGELPAAVGLLVQFAFRETREQVKEITYPSPLSWIKGLKWGEYVGSPSAPVPVVCFSQPHGERFGSLQALPTRAICGLSRNFCLLMTYSKEQGVRSMNSTDIQWSAILSWGYADNILRLKSKQSEPPVNFIQSSQQYQVTSCAWVPDSCQLFTGSKCGVITAYTNRFTSSTPSEIEMETQIHLYGHTEEITSLFVCKPYSILISVSRDGTCIIWDLNRLCYVQSLAGHKSPVTAVSASETSGDIATVCDSAGGGSDLRLWTVNGDLVGHVHCREIICSVAFSNQPEGVSINVIAGGLENGIVRLWSTWDLKPVREITFPKSNKPIISLTFSCDGHHLYTANSDGTVIAWCRKDQQRLKQPMFYSFLSSYAAG

SEQ ID NO: 47916 - protein, 1382 aa, Homo sapiens
  Payload ID: 9692
  Gene Symbol: LYST
  Gene Name: lysosomal trafficking regulator
  ENSP ID: ENSP00000374444
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTRATDQKVQST

SEQ ID NO: 47917 - protein, 181 aa, Homo sapiens
  Payload ID: 9692
  Gene Symbol: LYST
  Gene Name: lysosomal trafficking regulator
  ENSP ID: ENSP00000417168
  MOD_RES (1)..(1): Any amino acid
XIPMSEYKLLACDIQQLFIAVTIHACSSSGSQYFRVIEDLIVMLGYLQNSKNKRTQNMAVALQLRVLQAAMEFIRTTANHDSENLTDSLQSPSAPHHAVVQKRKSIAGSIPMKGSIIPHLPRHHFGSYGQLPMPFSFGPLNQDSSPQFSPGCTTCVVPPGAGPRKFPLAQTESLLMKMRSV

SEQ ID NO: 47918 - protein, 417 aa, Homo sapiens
  Payload ID: 9693
  Gene Symbol: LAMP1
  Gene Name: lysosomal-associated membrane protein 1
  Uniprot ID: P11279
  ENSP ID: ENSP00000333298
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 47919 - protein, 410 aa, Homo sapiens
  Payload ID: 9694
  Gene Symbol: LAMP2
  Gene Name: lysosomal-associated membrane protein 2
  Uniprot ID: P13473
  ENSP ID: ENSP00000200639
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKHHHAGYEQF

SEQ ID NO: 47920 - protein, 410 aa, Homo sapiens
  Payload ID: 9694
  Gene Symbol: LAMP2
  Gene Name: lysosomal-associated membrane protein 2
  Uniprot ID: P13473
  ENSP ID: ENSP00000360386
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQECSLDDDTILIPIIVGAGLSGLIIVIVIAYVIGRRKSYAGYQTL

SEQ ID NO: 47921 - protein, 411 aa, Homo sapiens
  Payload ID: 9694
  Gene Symbol: LAMP2
  Gene Name: lysosomal-associated membrane protein 2
  Uniprot ID: P13473
  ENSP ID: ENSP00000408411
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAEECSADSDLNFLIPVAVGVALGFLIIVVFISYMIGRRKSRTGYQSV

SEQ ID NO: 47922 - protein, 258 aa, Homo sapiens
  Payload ID: 9694
  Gene Symbol: LAMP2
  Gene Name: lysosomal-associated membrane protein 2
  ENSP ID: ENSP00000431526
  MOD_RES (1)..(1): Any amino acid
XNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQECSLDDDTILIPIIVGAGLSGLIIVIVIAYVIGRRKSYAGYQTL

SEQ ID NO: 47923 - protein, 416 aa, Homo sapiens
  Payload ID: 9695
  Gene Symbol: LAMP3
  Gene Name: lysosomal-associated membrane protein 3
  Uniprot ID: Q9UQV4
  ENSP ID: ENSP00000265598
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETIYQGIKHAVVMFQTAVGHSFKCVSEQSLQLSAHLQVKTTDVQLQAFDFEDDHFGNVDECSSDYTIVLPVIGAIVVGLCLMGMGVYKIRLRCQSSGYQRI

SEQ ID NO: 47924 - protein, 392 aa, Homo sapiens
  Payload ID: 9695
  Gene Symbol: LAMP3
  Gene Name: lysosomal-associated membrane protein 3
  ENSP ID: ENSP00000418912
MRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETIYQGIKHAVVMFQTAVGHSFKCVSEQSLQLSAHLQVKTTDVQLQAFDFEDDHFGNVDECSSDYTIVLPVIGAIVVGLCLMGMGVYKIRLRCQSSGYQRI

SEQ ID NO: 47925 - protein, 180 aa, Homo sapiens
  Payload ID: 9695
  Gene Symbol: LAMP3
  Gene Name: lysosomal-associated membrane protein 3
  ENSP ID: ENSP00000419059
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKST

SEQ ID NO: 47926 - protein, 143 aa, Homo sapiens
  Payload ID: 9695
  Gene Symbol: LAMP3
  Gene Name: lysosomal-associated membrane protein 3
  ENSP ID: ENSP00000420589
MRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTT

SEQ ID NO: 47927 - protein, 280 aa, Homo sapiens
  Payload ID: 9696
  Gene Symbol: LAMP5
  Gene Name: lysosomal-associated membrane protein family, member 5
  Uniprot ID: Q9UJQ1
  ENSP ID: ENSP00000246070
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 47928 - protein, 236 aa, Homo sapiens
  Payload ID: 9696
  Gene Symbol: LAMP5
  Gene Name: lysosomal-associated membrane protein family, member 5
  Uniprot ID: Q9UJQ1
  ENSP ID: ENSP00000406360
MDLQGRGVPSIDRLRVLLMLFHTMAQIMAEQEVENLSGLSTNPEKDIFVVRENGTTCLMAEFAAKFIVPYDVWASNYVDESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 47929 - protein, 148 aa, Homo sapiens
  Payload ID: 9697
  Gene Symbol: LYZ
  Gene Name: lysozyme
  Uniprot ID: P61626
  ENSP ID: ENSP00000261267
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRQYVQGCGV

SEQ ID NO: 47930 - protein, 137 aa, Homo sapiens
  Payload ID: 9697
  Gene Symbol: LYZ
  Gene Name: lysozyme
  ENSP ID: ENSP00000449898
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSGWHGEIVVKTEMSVSMFKVVECNSRIFLLQLILSLSH

SEQ ID NO: 47931 - protein, 104 aa, Homo sapiens
  Payload ID: 9697
  Gene Symbol: LYZ
  Gene Name: lysozyme
  ENSP ID: ENSP00000449969
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSGKTS

SEQ ID NO: 47932 - protein, 194 aa, Homo sapiens
  Payload ID: 9698
  Gene Symbol: LYG1
  Gene Name: lysozyme G-like 1
  Uniprot ID: Q8N1E2
  ENSP ID: ENSP00000311320
MSALWLLLGLLALMDLSESSNWGCYGNIQSLDTPGASCGIGRRHGLNYCGVRASERLAEIDMPYLLKYQPMMQTIGQKYCMDPAVIAGVLSRKSPGDKILVNMGDRTSMVQDPGSQAPTSWISESQVSQTTEVLTTRIKEIQRRFPTWTPDQYLRGGLCAYSGGAGYVRSSQDLSCDFCNDVLARAKYLKRHGF

SEQ ID NO: 47933 - protein, 194 aa, Homo sapiens; identical to SEQ ID NO: 47932
  Payload ID: 9698
  Gene Symbol: LYG1
  Gene Name: lysozyme G-like 1
  Uniprot ID: Q8N1E2
  ENSP ID: ENSP00000386923

SEQ ID NO: 47934 - protein, 212 aa, Homo sapiens
  Payload ID: 9699
  Gene Symbol: LYG2
  Gene Name: lysozyme G-like 2
  Uniprot ID: Q86SG7
  ENSP ID: ENSP00000327533
MLSSVVFWGLIALIGTSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVAQHLKGGLSAFKSGIEAIATPSDIDNDFVNDIIARAKFYKRQSF

SEQ ID NO: 47935 - protein, 182 aa, Homo sapiens
  Payload ID: 9699
  Gene Symbol: LYG2
  Gene Name: lysozyme G-like 2
  ENSP ID: ENSP00000386381
MLSSVVFWGLIALIGTSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVAQHLKGRLYSEYFV

SEQ ID NO: 47936 - protein, 212 aa, Homo sapiens; identical to SEQ ID NO: 47934
  Payload ID: 9699
  Gene Symbol: LYG2
  Gene Name: lysozyme G-like 2
  Uniprot ID: Q86SG7
  ENSP ID: ENSP00000386939

SEQ ID NO: 47937 - protein, 178 aa, Homo sapiens
  Payload ID: 9699
  Gene Symbol: LYG2
  Gene Name: lysozyme G-like 2
  Uniprot ID: Q86SG7
  ENSP ID: ENSP00000390357
MLSSVVFWGLIALIGTSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVAQHLKGFFLL

SEQ ID NO: 47938 - protein, 169 aa, Homo sapiens
  Payload ID: 9699
  Gene Symbol: LYG2
  Gene Name: lysozyme G-like 2
  ENSP ID: ENSP00000405439
MLSSVVFWGLIALIGTSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVA

SEQ ID NO: 47939 - protein, 178 aa, Homo sapiens; identical to SEQ ID NO: 47937
  Payload ID: 9699
  Gene Symbol: LYG2
  Gene Name: lysozyme G-like 2
  Uniprot ID: Q86SG7
  ENSP ID: ENSP00000487012

SEQ ID NO: 47940 - protein, 194 aa, Homo sapiens
  Payload ID: 9700
  Gene Symbol: LYZL1
  Gene Name: lysozyme-like 1
  Uniprot ID: Q6UWQ5
  ENSP ID: ENSP00000364650
MQDAPLSCLSPTKWSSVSSADSTEKSASGAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALITDDLTDAIICARKIVKETQGMNYWQGWKKHCEGRDLSEWKKGCEVS

SEQ ID NO: 47941 - protein, 106 aa, Homo sapiens
  Payload ID: 9700
  Gene Symbol: LYZL1
  Gene Name: lysozyme-like 1
  ENSP ID: ENSP00000434629
KIYTRCKLAKIFSRAGLDNYWGFSLGNWICMAYYESGYNTTAQTVLDDGSIDYGIFQINSFAWCRRGKLKENNHCHVACSALITDDLTDAIICARKIVKETQGMNY

SEQ ID NO: 47942 - protein, 194 aa, Homo sapiens
  Payload ID: 9701
  Gene Symbol: LYZL2
  Gene Name: lysozyme-like 2
  Uniprot ID: Q7Z4W2
  ENSP ID: ENSP00000364467
MQDAPLSCLSPTKWSSVSSADSTEKSASAAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALVTDDLTDAIICAKKIVKETQGMNYWQGWKKHCEGRDLSDWKKDCEVS

SEQ ID NO: 47943 - protein, 146 aa, Homo sapiens
  Payload ID: 9702
  Gene Symbol: LYZL4
  Gene Name: lysozyme-like 4
  Uniprot ID: Q96KX0
  ENSP ID: ENSP00000287748
MKASVVLSLLGYLVVPSGAYILGRCTVAKKLHDGGLDYFEGYSLENWVCLAYFESKFNPMAIYENTREGYTGFGLFQMRGSDWCGDHGRNRCHMSCSALLNPNLEKTIKCAKTIVKGKEGMGAWPTWSRYCQYSDTLARWLDGCKL

SEQ ID NO: 47944 - protein, 146 aa, Homo sapiens; identical to SEQ ID NO: 47943
  Payload ID: 9702
  Gene Symbol: LYZL4
  Gene Name: lysozyme-like 4
  Uniprot ID: Q96KX0
  ENSP ID: ENSP00000387897

SEQ ID NO: 47945 - protein, 86 aa, Homo sapiens
  Payload ID: 9703
  Gene Symbol: LYZL6
  Gene Name: lysozyme-like 6
  ENSP ID: ENSP00000481373
  MOD_RES (1)..(1): Any amino acid
XLEDLDGFEGYSLSDWLCLAFVESKFNISKINENADGSFDYGLFQINSHYWCNDYKSYSENLCHVDCQGIHCAKRIVSGARGMNNW

SEQ ID NO: 47946 - protein, 148 aa, Homo sapiens
  Payload ID: 9703
  Gene Symbol: LYZL6
  Gene Name: lysozyme-like 6
  Uniprot ID: O75951
  ENSP ID: ENSP00000482955
MTKALLIYLVSSFLALNQASLISRCDLAQVLQLEDLDGFEGYSLSDWLCLAFVESKFNISKINENADGSFDYGLFQINSHYWCNDYKSYSENLCHVDCQDLLNPNLLAGIHCAKRIVSGARGMNNWVEWRLHCSGRPLFYWLTGCRLR

SEQ ID NO: 47947 - protein, 148 aa, Homo sapiens; identical to SEQ ID NO: 47946
  Payload ID: 9703
  Gene Symbol: LYZL6
  Gene Name: lysozyme-like 6
  Uniprot ID: O75951
  ENSP ID: ENSP00000483358

SEQ ID NO: 47948 - protein, 148 aa, Homo sapiens; identical to SEQ ID NO: 47946
  Payload ID: 9703
  Gene Symbol: LYZL6
  Gene Name: lysozyme-like 6
  Uniprot ID: O75951
  ENSP ID: ENSP00000483897

SEQ ID NO: 47949 - protein, 86 aa, Homo sapiens; identical to SEQ ID NO: 47945
  Payload ID: 9703
  Gene Symbol: LYZL6
  Gene Name: lysozyme-like 6
  ENSP ID: ENSP00000487953
  MOD_RES (1)..(1): Any amino acid

SEQ ID NO: 47950 - protein, 148 aa, Homo sapiens; identical to SEQ ID NO: 47946
  Payload ID: 9703
  Gene Symbol: LYZL6
  Gene Name: lysozyme-like 6
  ENSP ID: ENSP00000488304

SEQ ID NO: 47951 - protein, 417 aa, Homo sapiens
  Payload ID: 9704
  Gene Symbol: LOX
  Gene Name: lysyl oxidase
  Uniprot ID: P28300
  ENSP ID: ENSP00000231004
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 47952 - protein, 61 aa, Homo sapiens
  Payload ID: 9704
  Gene Symbol: LOX
  Gene Name: lysyl oxidase
  ENSP ID: ENSP00000427538
YNPYKYSDDNPYYNYYDTYERPRPGGRYRPGYGTGYFQYVQHTGQMSEIMITGCCSDFPKE

SEQ ID NO: 47953 - protein, 574 aa, Homo sapiens
  Payload ID: 9705
  Gene Symbol: LOXL1
  Gene Name: lysyl oxidase-like 1
  Uniprot ID: Q08397
  ENSP ID: ENSP00000261921
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 47954 - protein, 431 aa, Homo sapiens
  Payload ID: 9705
  Gene Symbol: LOXL1
  Gene Name: lysyl oxidase-like 1
  ENSP ID: ENSP00000457827
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRVTPAQTPACPGRKVEGQEQDGQAPGSGTSWGTRDHKDGGSLQTSPGRLTPGLAGERARASLRSP

SEQ ID NO: 47955 - protein, 774 aa, Homo sapiens
  Payload ID: 9706
  Gene Symbol: LOXL2
  Gene Name: lysyl oxidase-like 2
  Uniprot ID: Q9Y4K0
  ENSP ID: ENSP00000373783
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 47956 - protein, 67 aa, Homo sapiens
  Payload ID: 9706
  Gene Symbol: LOXL2
  Gene Name: lysyl oxidase-like 2
  ENSP ID: ENSP00000427826
RIRAILSTYRKRTPVMEGYVEVKEGKTWKQICDKHWTAKNSRVVCGMFGFPGERTYNTKVYNNPWCD

SEQ ID NO: 47957 - protein, 258 aa, Homo sapiens
  Payload ID: 9706
  Gene Symbol: LOXL2
  Gene Name: lysyl oxidase-like 2
  ENSP ID: ENSP00000427883
MEASKVLDKSKAAAIGDQSRPLCSRKGLSGGGSGGGPPWRARSQPGHCGSLKPKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIE

SEQ ID NO: 47958 - protein, 207 aa, Homo sapiens
  Payload ID: 9706
  Gene Symbol: LOXL2
  Gene Name: lysyl oxidase-like 2
  ENSP ID: ENSP00000427907
  MOD_RES (1)..(1): Any amino acid
XENGLPAVVSCVPGQVFSPDGPSRFRKAYKPEQDRVSLQQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQ

SEQ ID NO: 47959 - protein, 139 aa, Homo sapiens
  Payload ID: 9706
  Gene Symbol: LOXL2
  Gene Name: lysyl oxidase-like 2
  ENSP ID: ENSP00000428497
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACT

SEQ ID NO: 47960 - protein, 95 aa, Homo sapiens
  Payload ID: 9706
  Gene Symbol: LOXL2
  Gene Name: lysyl oxidase-like 2
  ENSP ID: ENSP00000428933
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHV

SEQ ID NO: 47961 - protein, 218 aa, Homo sapiens
  Payload ID: 9706
  Gene Symbol: LOXL2
  Gene Name: lysyl oxidase-like 2
  ENSP ID: ENSP00000429778
MEASKVLDKSKAAESSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIE

SEQ ID NO: 47962 - protein, 151 aa, Homo sapiens
  Payload ID: 9706
  Gene Symbol: LOXL2
  Gene Name: lysyl oxidase-like 2
  ENSP ID: ENSP00000430519
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHT

SEQ ID NO: 47963 - protein, 101 aa, Homo sapiens
  Payload ID: 9706
  Gene Symbol: LOXL2
  Gene Name: lysyl oxidase-like 2
  ENSP ID: ENSP00000473322
MERPLCSHLCSCLAMLALLSPLSLAQYDSWPHYPEYFQQPAPEYHQPQAPANVAKIQLHLVLARRCQQQQSGHEWSEVLGNGAVPGALPPRRGGRGLPPGR

SEQ ID NO: 47964 - protein, 753 aa, Homo sapiens
  Payload ID: 9707
  Gene Symbol: LOXL3
  Gene Name: lysyl oxidase-like 3
  Uniprot ID: P58215
  ENSP ID: ENSP00000264094
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 47965 - protein, 608 aa, Homo sapiens
  Payload ID: 9707
  Gene Symbol: LOXL3
  Gene Name: lysyl oxidase-like 3
  Uniprot ID: P58215
  ENSP ID: ENSP00000377512
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 47966 - protein, 586 aa, Homo sapiens
  Payload ID: 9707
  Gene Symbol: LOXL3
  Gene Name: lysyl oxidase-like 3
  ENSP ID: ENSP00000386545
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGI

SEQ ID NO: 47967 - protein, 697 aa, Homo sapiens
  Payload ID: 9707
  Gene Symbol: LOXL3
  Gene Name: lysyl oxidase-like 3
  ENSP ID: ENSP00000386696
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 47968 - protein, 471 aa, Homo sapiens
  Payload ID: 9707
  Gene Symbol: LOXL3
  Gene Name: lysyl oxidase-like 3
  ENSP ID: ENSP00000387103
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 47969 - protein, 303 aa, Homo sapiens
  Payload ID: 9707
  Gene Symbol: LOXL3
  Gene Name: lysyl oxidase-like 3
  ENSP ID: ENSP00000398260
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQG

SEQ ID NO: 47970 - protein, 180 aa, Homo sapiens
  Payload ID: 9707
  Gene Symbol: LOXL3
  Gene Name: lysyl oxidase-like 3
  ENSP ID: ENSP00000404026
  MOD_RES (1)..(1): Any amino acid
XRQRLERPQQPRGLRDAGLPQRKEGQRGLLQARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTL

SEQ ID NO: 47971 - protein, 756 aa, Homo sapiens
  Payload ID: 9708
  Gene Symbol: LOXL4
  Gene Name: lysyl oxidase-like 4
  Uniprot ID: Q96JB6
  ENSP ID: ENSP00000260702
MAWSPPATLFLFLLLLGQPPPSRPQSLGTTKLRLVGPESKPEEGRLEVLHQGQWGTVCDDNFAIQEATVACRQLGFEAALTWAHSAKYGQGEGPIWLDNVRCVGTESSLDQCGSNGWGVSDCSHSEDVGVICHPRRHRGYLSETVSNALGPQGRRLEEVRLKPILASAKQHSPVTEGAVEVKYEGHWRQVCDQGWTMNNSRVVCGMLGFPSEVPVDSHYYRKVWDLKMRDPKSRLKSLTNKNSFWIHQVTCLGTEPHMANCQVQVAPARGKLRPACPGGMHAVVSCVAGPHFRPPKTKPQRKGSWAEEPRVRLRSGAQVGEGRVEVLMNRQWGTVCDHRWNLISASVVCRQLGFGSAREALFGARLGQGLGPIHLSEVRCRGYERTLSDCPALEGSQNGCQHENDAAVRCNVPNMGFQNQVRLAGGRIPEEGLLEVQVEVNGVPRWGSVCSENWGLTEAMVACRQLGLGFAIHAYKETWFWSGTPRAQEVVMSGVRCSGTELALQQCQRHGPVHCSHGGGRFLAGVSCMDSAPDLVMNAQLVQETAYLEDRPLSQLYCAHEENCLSKSADHMDWPYGYRRLLRFSTQIYNLGRTDFRPKTGRDSWVWHQCHRHYHSIEVFTHYDLLTLNGSKVAEGHKASFCLEDTNCPTGLQRRYACANFGEQGVTVGCWDTYRHDIDCQWVDITDVGPGNYIFQVIVNPHYEVAESDFSNNMLQCRCKYDGHRVWLHNCHTGNSYPANAELSLEQEQRLRNNLI

SEQ ID NO: 47972 - protein, 597 aa, Homo sapiens
  Payload ID: 9709
  Gene Symbol: KARS
  Gene Name: lysyl-tRNA synthetase
  Uniprot ID: Q15046
  ENSP ID: ENSP00000303043
MAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEQAKAKAAGDDEAMFIDENFCTALEYGLPPTAGWGMGIDRVAMFLTDSNNIKEVLLFPAMKPEDKKENVATTDTLESTTVGTSV

SEQ ID NO: 47973 - protein, 625 aa, Homo sapiens
  Payload ID: 9709
  Gene Symbol: KARS
  Gene Name: lysyl-tRNA synthetase
  Uniprot ID: Q15046
  ENSP ID: ENSP00000325448
MLTQAAVRLVRGSLRKTSWAEWGHRELRLGQLAPFTAPHKDKSFSDQRSELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEQAKAKAAGDDEAMFIDENFCTALEYGLPPTAGWGMGIDRVAMFLTDSNNIKEVLLFPAMKPEDKKENVATTDTLESTTVGTSV

SEQ ID NO: 47974 - protein, 67 aa, Homo sapiens
  Payload ID: 9709
  Gene Symbol: KARS
  Gene Name: lysyl-tRNA synthetase
  ENSP ID: ENSP00000454512
MLTQAAVRLVRGSLRKTSWAEWGHRELRLGQLAPFTAPHKDKSFSDQRSTSVSCHETRRQEGECSNH

SEQ ID NO: 47975 - protein, 104 aa, Homo sapiens
  Payload ID: 9709
  Gene Symbol: KARS
  Gene Name: lysyl-tRNA synthetase
  ENSP ID: ENSP00000455488
IHINNKLRRGDIIGVQGNPGKTKKGELSIIPYEITLLSPCLHMLPHLHFGLKDKETRYRQRYLDLILNDFVRQKFIIRSKIITYIRSFLDELGFLEVRRVPCLT

SEQ ID NO: 47976 - protein, 124 aa, Homo sapiens
  Payload ID: 9709
  Gene Symbol: KARS
  Gene Name: lysyl-tRNA synthetase
  ENSP ID: ENSP00000455818
MLTQAAVRLVRGSLRKTSWAEWGHRELRLGQLAPFTAPHKDKSFSDQRSELKRRLKAEKKVAEKEAKQKELSEKQLSQATAAATNHTTDNGVGPEEESVDPNVGSMPKELLGESSSSMIFEERG

SEQ ID NO: 47977 - protein, 76 aa, Homo sapiens
  Payload ID: 9709
  Gene Symbol: KARS
  Gene Name: lysyl-tRNA synthetase
  ENSP ID: ENSP00000456185
MAAVQAAEVKVDGSEPKLSKNELKRRLKAEKKVAEKEAKQKELSEKQLSQATAAATNHTTDNGVGPEEESVDPNKL

SEQ ID NO: 47978 - protein, 86 aa, Homo sapiens
  Payload ID: 9709
  Gene Symbol: KARS
  Gene Name: lysyl-tRNA synthetase
  ENSP ID: ENSP00000456786
  MOD_RES (1)..(1): Any amino acid
XDGSEPKLSKNELKRRLKAEKKVAEKEAKQKELSEKQLSQATAAATNHTTDNGVGPEEESVDPNVGSMPKELLGESSSSMIFEERG

SEQ ID NO: 47979 - protein, 256 aa, Homo sapiens
  Payload ID: 9709
  Gene Symbol: KARS
  Gene Name: lysyl-tRNA synthetase
  ENSP ID: ENSP00000458028
MLTQAAVRLVRGSLRKTSWAEWGHRELRLGQLAPFTAPHKDKSFSDQRSELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYR

SEQ ID NO: 47980 - protein, 102 aa, Homo sapiens
  Payload ID: 9709
  Gene Symbol: KARS
  Gene Name: lysyl-tRNA synthetase
  ENSP ID: ENSP00000462057
MANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFL

SEQ ID NO: 47981 - protein, 522 aa, Homo sapiens
  Payload ID: 9710
  Gene Symbol: MB21D1
  Gene Name: Mab-21 domain containing 1
  Uniprot ID: Q8N884
  ENSP ID: ENSP00000359339
MQPWHGKAMQRASEAGATAPKASARNARGAPMDPTESPAAPEAALPKAGKFGPARKSGSRQKKSAPDTQERPPVRATGARAKKAPQRAQDTQPSDATSAPGAEGLEPPAAREPALSRAGSCRQRGARCSTKPRPPPGPWDVPSPGLPVSAPILVRRDAAPGASKLRAVLEKLKLSRDDISTAAGMVKGVVDHLLLRLKCDSAFRGVGLLNTGSYYEHVKISAPNEFDVMFKLEVPRIQLEEYSNTRAYYFVKFKRNPKENPLSQFLEGEILSASKMLSKFRKIIKEEINDIKDTDVIMKRKRGGSPAVTLLISEKISVDITLALESKSSWPASTQEGLRIQNWLSAKVRKQLRLKPFYLVPKHAKEGNGFQEETWRLSFSHIEKEILNNHGKSKTCCENKEEKCCRKDCLKLMKYLLEQLKERFKDKKHLDKFSSYHVKTAFFHVCTQNPQDSQWDRKDLGLCFDNCVTYFLQCLRTEKLENYFIPEFNLFSSNLIDKRSKEFLTKQIEYERNNEFPVFDEF

SEQ ID NO: 47982 - protein, 447 aa, Homo sapiens
  Payload ID: 9710
  Gene Symbol: MB21D1
  Gene Name: Mab-21 domain containing 1
  Uniprot ID: Q8N884
  ENSP ID: ENSP00000359342
MQPWHGKAMQRASEAGATAPKASARNARGAPMDPTESPAAPEAALPKAGKFGPARKSGSRQKKSAPDTQERPPVRATGARAKKAPQRAQDTQPSDATSAPGAEGLEPPAAREPALSRAGSCRQRGARCSTKPRPPPGPWDVPSPGLPVSAPILVRRDAAPGASKLRAVLEKLKLSRDDISTAAGMVKGVVDHLLLRLKCDSAFRGVGLLNTGSYYEHVKISAPNEFDVMFKLEVPRIQLEEYSNTRAYYFVKFKRNPKENPLSQFLEGEILSASKMLSKFRKIIKEEINDIKDTDVIMKRKRGGSPAVTLLISEKISVDITLALESKSSWPASTQEGLRIQNWLSAKVRKQLRLKPFYLVPKHAKEGNGFQEETWRLSFSHIEKEILNNHGKSKTCCENKEEKCCRKDCLKLMKYLLEQLKERFKDKKHLDKFSSYHVKTAFFHRLY

SEQ ID NO: 47983 - protein, 491 aa, Homo sapiens
  Payload ID: 9711
  Gene Symbol: MB21D2
  Gene Name: Mab-21 domain containing 2
  Uniprot ID: Q8IYB1
  ENSP ID: ENSP00000376246
MKMAAPTANKAASLGCNNKPAFPELDFRSGARVEELNKLIQEFTKHDQREYDDQRALEIHTAKDFIFSMLGMVQKLDQKLPVANEYLLLSGGVREGVVDLDLDELNVYARGTDYDMDFTLLVPALKLHDRNQPVTLDMRHSALCHSWLSLRLFDEGTISKWKDCCTIVDHINGATNYFFSPTKVADWFYDSISIVLSEIQKKPQRGMPKVEKVEKNGTIISIILGVGSSRMLYDIVPVVSFKGWPAVAQSWLMENHFWDGKITEEEVISGFYLVPACSYKGKKDNEWRLSFARSEVQLKKCISSSLMQAYQACKAIIIKLLSRPKAISPYHLRSMMLWACDRLPANYLAQEDYAAHFLLGLIDDLQHCLVNKMCPNYFIPQCNMLEHLSEETVMLHARKLSSVRSDPAEHLRTAIEHVKAANRLTLELQRRGSTTSIPSPQSDGGDPNQPDDRLAKKLQQLVTENPGKSISVFINPDDVTRPHFRIDDKFF

SEQ ID NO: 47984 - protein, 359 aa, Homo sapiens
  Payload ID: 9712
  Gene Symbol: MAB21L1
  Gene Name: mab-21-like 1 (C. elegans)
  Uniprot ID: Q13394
  ENSP ID: ENSP00000369251
MIAAQAKLVYHLNKYYNEKCQARKAAIAKTIREVCKVVSDVLKEVEVQEPRFISSLNEMDNRYEGLEVISPTEFEVVLYLNQMGVFNFVDDGSLPGCAVLKLSDGRKRSMSLWVEFITASGYLSARKIRSRFQTLVAQAVDKCSYRDVVKMVADTSEVKLRIRDRYVVQITPAFKCTGIWPRSAAHWPLPHIPWPGPNRVAEVKAEGFNLLSKECHSLAGKQSSAESDAWVLQFAEAENRLQMGGCRKKCLSILKTLRDRHLELPGQPLNNYHMKTLVSYECEKHPRESDWDESCLGDRLNGILLQLISCLQCRRCPHYFLPNLDLFQGKPHSALENAAKQTWRLAREILTNPKSLEKL

SEQ ID NO: 47985 - protein, 359 aa, Homo sapiens
  Payload ID: 9713
  Gene Symbol: MAB21L2
  Gene Name: mab-21-like 2 (C. elegans)
  Uniprot ID: Q9Y586
  ENSP ID: ENSP00000324701
MIAAQAKLVYQLNKYYTERCQARKAAIAKTIREVCKVVSDVLKEVEVQEPRFISSLSEIDARYEGLEVISPTEFEVVLYLNQMGVFNFVDDGSLPGCAVLKLSDGRKRSMSLWVEFITASGYLSARKIRSRFQTLVAQAVDKCSYRDVVKMIADTSEVKLRIRERYVVQITPAFKCTGIWPRSAAQWPMPHIPWPGPNRVAEVKAEGFNLLSKECYSLTGKQSSAESDAWVLQFGEAENRLLMGGCRNKCLSVLKTLRDRHLELPGQPLNNYHMKTLLLYECEKHPRETDWDESCLGDRLNGILLQLISCLQCRRCPHYFLPNLDLFQGKPHSALESAAKQTWRLAREILTNPKSLDKL

SEQ ID NO: 47986 - protein, 362 aa, Homo sapiens [sequence omitted]

SEQ ID NO: 47987 - protein, 325 aa, Homo sapiens
  Payload ID: 9715
  Gene Symbol: MACROD1
  Gene Name: MACRO domain containing 1
  Uniprot ID: Q9BQ69
  ENSP ID: ENSP00000255681
MSLQSRLSGRLAQLRAAGQLLVPPRPRPGHLAGATRTRSSTCGPPAFLGVFGRRARTSAGVGAWGAAAVGRTAGVRTWAPLAMAAKVDLSTSTDWKEAKSFLKGLSDKQREEHYFCKDFVRLKKIPTWKEMAKGVAVKVEEPRYKKDKQLNEKISLLRSDITKLEVDAIVNAANSSLLGGGGVDGCIHRAAGPLLTDECRTLQSCKTGKAKITGGYRLPAKYVIHTVGPIAYGEPSASQAAELRSCYLSSLDLLLEHRLRSVAFPCISTGVFGYPCEAAAEIVLATLREWLEQHKDKVDRLIICVFLEKDEDIYRSRLPHYFPVA

SEQ ID NO: 47988 - protein, 425 aa, Homo sapiens
  Payload ID: 9716
  Gene Symbol: MACROD2
  Gene Name: MACRO domain containing 2
  Uniprot ID: A1Z1Q3
  ENSP ID: ENSP00000217246
MYPSNKKKKVWREEKERLLKMTLEERRKEYLRDYIPLNSILSWKEEMKGKGQNDEENTQETSQVKKSLTEKVSLYRGDITLLEVDAIVNAANASLLGGGGVDGCIHRAAGPCLLAECRNLNGCDTGHAKITCGYDLPAKYVIHTVGPIARGHINGSHKEDLANCYKSSLKLVKENNIRSVAFPCISTGIYGFPNEPAAVIALNTIKEWLAKNHHEVDRIIFCVFLEVDFKIYKKKMNEFFSVDDNNEEEEDVEMKEDSDENGPEEKQSVEEMEEQSQDADGVNTVTVPGPASEEAVEDCKDEDFAKDENITKGGEVTDHSVRDQDHPDGQENDSTKNEIKIETESQSSYMETEELSSNQEDAVIVEQPEVIPLTEDQEEKEGEKAPGEDTPRMPGKSEGSSDLENTPGPDAGAQDEAKEQRNGTK

SEQ ID NO: 47989 - protein, 213 aa, Homo sapiens
  Payload ID: 9716
  Gene Symbol: MACROD2
  Gene Name: MACRO domain containing 2
  Uniprot ID: A1Z1Q3
  ENSP ID: ENSP00000367297
MNEFFSVDDNNEEEEDVEMKEDSDENGPEEKQSVEEMEEQSQDADGVNTVTVPGPASEEAVEDCKDEDFAKDENITKGGEVTDHSVRDQDHPDGQENDSTKNEIKIETESQSSYMETEELSSNQEDAVIVEQPEVIPLTEDQEEKEGEKAPGEDTPRMPGKSEGSSDLENTPGPDVEMNSQVDKVNDPTESQQEDQLIAGAQDEAKEQRNGTK

SEQ ID NO: 47990 - protein, 213 aa, Homo sapiens; identical to SEQ ID NO: 47989
  Payload ID: 9716
  Gene Symbol: MACROD2
  Gene Name: MACRO domain containing 2
  Uniprot ID: A1Z1Q3
  ENSP ID: ENSP00000385290

SEQ ID NO: 47991 - protein, 98 aa, Homo sapiens
  Payload ID: 9716
  Gene Symbol: MACROD2
  Gene Name: MACRO domain containing 2
  Uniprot ID: A1Z1Q3
  ENSP ID: ENSP00000385516
METEELSSNQEDAVIVEQPEVIPLTEDQEEKEGEKAPGEDTPRMPGKSEGSSDLENTPGPDVEMNSQVDKVNDPTESQQEDQLIGAQDEAKEQRNGTK

SEQ ID NO: 47992 - protein, 355 aa, Homo sapiens
  Payload ID: 9717
  Gene Symbol: MAEA
  Gene Name: macrophage erythroblast attacher
  Uniprot ID: Q7L5Y9
  ENSP ID: ENSP00000264750
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIESCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 47993 - protein, 396 aa, Homo sapiens
  Payload ID: 9717
  Gene Symbol: MAEA
  Gene Name: macrophage erythroblast attacher
  Uniprot ID: Q7L5Y9
  ENSP ID: ENSP00000302830
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 47994 - protein, 274 aa, Homo sapiens
  Payload ID: 9717
  Gene Symbol: MAEA
  Gene Name: macrophage erythroblast attacher
  ENSP ID: ENSP00000421644
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKTCKKALQPSRREPAGRGAPGHGHAGLPARHAHLPVQGPSGPCTVADADPAVPVRQLPTTPAGKQFCVHPHPAGWPLSHQDT

SEQ ID NO: 47995 - protein, 434 aa, Homo sapiens
  Payload ID: 9717
  Gene Symbol: MAEA
  Gene Name: macrophage erythroblast attacher
  ENSP ID: ENSP00000422215
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKGRQNKHEAKTGRKSRAASSSPKESLDLGMETLKGKPELSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 47996 - protein, 67 aa, Homo sapiens
  Payload ID: 9717
  Gene Symbol: MAEA
  Gene Name: macrophage erythroblast attacher
  ENSP ID: ENSP00000422235
MAVQESAAQLSMTLKVQEYPTLKNIPAWKPRCARPLHWPQKPHLSAEEPGCCLEWVSSTAWQHSHAS

SEQ ID NO: 47997 - protein, 107 aa, Homo sapiens
  Payload ID: 9717
  Gene Symbol: MAEA
  Gene Name: macrophage erythroblast attacher
  ENSP ID: ENSP00000423056
MAVQESAAQLSMTLKVQEYPTLKVPYETLNKRFRAAQKNIDRETSHVTMVVAELEKTLSGCPAVDSVVSLLDGVVEKLSVLKRKVGPAWRSLFSLGHGHPFCLENES

SEQ ID NO: 47998 - protein, 348 aa, Homo sapiens
  Payload ID: 9717
  Gene Symbol: MAEA
  Gene Name: macrophage erythroblast attacher
  ENSP ID: ENSP00000424436
MVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 47999 - protein, 107 aa, Homo sapiens; identical to SEQ ID NO: 47997
  Payload ID: 9717
  Gene Symbol: MAEA
  Gene Name: macrophage erythroblast attacher
  ENSP ID: ENSP00000426326

SEQ ID NO: 48000 - protein, 395 aa, Homo sapiens
  Payload ID: 9717
  Gene Symbol: MAEA
  Gene Name: macrophage erythroblast attacher
  ENSP ID: ENSP00000426807
MWTLRATGREVGSSSCEDTVAPVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 48001 - protein, 183 aa, Homo sapiens
  Payload ID: 9717
  Gene Symbol: MAEA
  Gene Name: macrophage erythroblast attacher
  ENSP ID: ENSP00000426903
MAVQESAAQLSMTLKVQEYPTLKVPYETLNKRFRAAQKNIDRETSHVTMVVAELEKTLSGCPAVDSVVSLLDGVVEKLSVLKRKDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHI

SEQ ID NO: 48002 - protein, 245 aa, Homo sapiens
  Payload ID: 9717
  Gene Symbol: MAEA
  Gene Name: macrophage erythroblast attacher
  ENSP ID: ENSP00000426966
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIETCKKALQPSRREPAGRGAPGHGHAGLPARHAHLPVQGPSGPCTVADADPAVPVRQLPTTPAGKQFCVHPHPAGWPLSHQDTTVLQGGRQLQEP

SEQ ID NO: 48003 - protein, 115 aa, Homo sapiens
  Payload ID: 9717
  Gene Symbol: MAEA
  Gene Name: macrophage erythroblast attacher
  ENSP ID: ENSP00000427460
MVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTA

SEQ ID NO: 48004 - protein, 328 aa, Homo sapiens
  Payload ID: 9717
  Gene Symbol: MAEA
  Gene Name: macrophage erythroblast attacher
  ENSP ID: ENSP00000427512
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIETCKKALQPSRREPAGRGAPGHGHAGLPARHAHLPVQGPSGPCTVADADPAVPVRQLPTTPAGKQFCVHPHPAGWPLSHQDTCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 48005 - protein, 716 aa, Homo sapiens
  Payload ID: 9718
  Gene Symbol: MPEG1
  Gene Name: macrophage expressed 1
  Uniprot ID: Q2M385
  ENSP ID: ENSP00000354335
MNNFRATILFWAAAAWAKSGKPSGEMDEVGVQKCKNALKLPVLEVLPGGGWDNLRNVDMGRVMELTYSNCRTTEDGQYIIPDEIFTIPQKQSNLEMNSEILESWANYQSSTSYSINTELSLFSKVNGKFSTEFQRMKTLQVKDQAITTRVQVRNLVYTVKINPTLELSSGFRKELLDISDRLENNQTRMATYLAELLVLNYGTHVTTSVDAGAALIQEDHLRASFLQDSQSSRSAVTASAGLAFQNTVNFKFEENYTSQNVLTKSYLSNRTNSRVQSIGGVPFYPGITLQAWQQGITNHLVAIDRSGLPLHFFINPNMLPDLPGPLVKKVSKTVETAVKRYYTFNTYPGCTDLNSPNFNFQANTDDGSCEGKMTNFSFGGVYQECTQLSGNRDVLLCQKLEQKNPLTGDFSCPSGYSPVHLLSQIHEEGYNHLECHRKCTLLVFCKTVCEDVFQVAKAEFRAFWCVASSQVPENSGLLFGGLFSSKSINPMTNAQSCPAGYFPLRLFENLKVCVSQDYELGSRFAVPFGGFFSCTVGNPLVDPAISRDLGAPSLKKCPGGFSQHPALISDGCQVSYCVKSGLFTGGSLPPARLPPFTRPPLMSQAATNTVIVTNSENARSWIKDSQTHQWRLGEPIELRRAMNVIHGDGGGLSGGAAAGVTVGVTTILAVVITLAIYGTRKFKKKAYQAIEERQSLVPGTAATGDTTYQEQGQSPA

SEQ ID NO: 48006 - protein, 115 aa, Homo sapiens
  Payload ID: 9719
  Gene Symbol: MIF
  Gene Name: macrophage migration inhibitory factor (glycosylation-inhibiting factor)
  Uniprot ID: P14174
  ENSP ID: ENSP00000215754
MPMFIVNTNVPRASVPDGFLSELTQQLAQATGKPPQYIAVHVVPDQLMAFGGSSEPCALCSLHSIGKIGGAQNRSYSKLLCGLLAERLRISPDRVYINYYDMNAANVGWNNSTFA

SEQ ID NO: 48007 - protein, 115 aa, Homo sapiens; identical to SEQ ID NO: 48006
  Payload ID: 9719
  Gene Symbol: MIF
  Gene Name: macrophage migration inhibitory factor (glycosylation-inhibiting factor)
  Uniprot ID: P14174
  ENSP ID: ENSP00000482779

SEQ ID NO: 48008 - protein, 520 aa, Homo sapiens
  Payload ID: 9720
  Gene Symbol: MARCO
  Gene Name: macrophage receptor with collagenous structure
  Uniprot ID: Q9UEW3
  ENSP ID: ENSP00000318916
MRNKKILKEDELLSETQQAAFHQIAMEPFEINVPKPKRRNGVNFSLAVVVIYLILLTAGAGLLVVQVLNLQARLRVLEMYFLNDTLAAEDSPSFSLLQSAHPGEHLAQGASRLQVLQAQLTWVRVSHEHLLQRVDNFTQNPGMFRIKGEQGAPGLQGHKGAMGMPGAPGPPGPPAEKGAKGAMGRDGATGPSGPQGPPGVKGEAGLQGPQGAPGKQGATGTPGPQGEKGSKGDGGLIGPKGETGTKGEKGDLGLPGSKGDRGMKGDAGVMGPPGAQGSKGDFGRPGPPGLAGFPGAKGDQGQPGLQGVPGPPGAVGHPGAKGEPGSAGSPGRAGLPGSPGSPGATGLKGSKGDTGLQGQQGRKGESGVPGPAGVKGEQGSPGLAGPKGAPGQAGQKGDQGVKGSSGEQGVKGEKGERGENSVSVRIVGSSNRGRAEVYYSGTWGTICDDEWQNSDAIVFCRMLGYSKGRALYKVGAGTGQIWLDNVQCRGTESTLWSCTKNSWGHHDCSHEEDAGVECSV

SEQ ID NO: 48009 - protein, 63 aa, Homo sapiens
  Payload ID: 9720
  Gene Symbol: MARCO
  Gene Name: macrophage receptor with collagenous structure
  ENSP ID: ENSP00000409192
MYFLNDTLAAEDSPSFSLLQSAHPGEHLAQGASRLQVLQAQLTWVRVSHEHLLQRVDNFTQNP

SEQ ID NO: 48010 - protein, 388 aa, Homo sapiens
  Payload ID: 9721
  Gene Symbol: MSR1
  Gene Name: macrophage scavenger receptor 1
  Uniprot ID: P21757
  ENSP ID: ENSP00000262100
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLSTGPIWLNEVFCFGRESSIEECKIRQWGTRACSHSEDAGVTCTL

SEQ ID NO: 48011 - protein, 451 aa, Homo sapiens
  Payload ID: 9721
  Gene Symbol: MSR1
  Gene Name: macrophage scavenger receptor 1
  Uniprot ID: P21757
  ENSP ID: ENSP00000262101
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLTPFTKVRLVGGSGPHEGRVEILHSGQWGTICDDRWEVRVGQVVCRSLGYPGVQAVHKAAHFGQGTGPIWLNEVFCFGRESSIEECKIRQWGTRACSHSEDAGVTCTL

SEQ ID NO: 48012 - protein, 388 aa, Homo sapiens; identical to SEQ ID NO: 48010
  Payload ID: 9721
  Gene Symbol: MSR1
  Gene Name: macrophage scavenger receptor 1
  Uniprot ID: P21757
  ENSP ID: ENSP00000347430

SEQ ID NO: 48013 - protein, 358 aa, Homo sapiens
  Payload ID: 9721
  Gene Symbol: MSR1
  Gene Name: macrophage scavenger receptor 1
  Uniprot ID: P21757
  ENSP ID: ENSP00000371428
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLRPVQLTDHIRAGPS

SEQ ID NO: 48014 - protein, 469 aa, Homo sapiens
  Payload ID: 9721
  Gene Symbol: MSR1
  Gene Name: macrophage scavenger receptor 1
  ENSP ID: ENSP00000405453
MCYLSAIISISLLNKKPSMEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLTPFTKVRLVGGSGPHEGRVEILHSGQWGTICDDRWEVRVGQVVCRSLGYPGVQAVHKAAHFGQGTGPIWLNEVFCFGRESSIEECKIRQWGTRACSHSEDAGVTCTL

SEQ ID NO: 48015 - protein, 64 aa, Homo sapiens
  Payload ID: 9721
  Gene Symbol: MSR1
  Gene Name: macrophage scavenger receptor 1
  ENSP ID: ENSP00000427905
MEQWDHFHNQQEDTDSCSESVKFDARSMTALLPPNPKNSPSLQEKLKSFKAALIALYLLVFAVL

SEQ ID NO: 48016 - protein, 37 aa, Homo sapiens
  Payload ID: 9721
  Gene Symbol: MSR1
  Gene Name: macrophage scavenger receptor 1
  ENSP ID: ENSP00000428865
MEQWDHFHNQQEDTDSCSESVKFDARSMTALLPPRNQ

SEQ ID NO: 48017 - protein, 58 aa, Homo sapiens
  Payload ID: 9721
  Gene Symbol: MSR1
  Gene Name: macrophage scavenger receptor 1
  ENSP ID: ENSP00000429498
MHLLQAGTSGSMEQWDHFHNQQEDTDSCSESVKFDARSMTALLPPNPKNSPSLQEKLK

SEQ ID NO: 48018 - protein, 149 aa, Homo sapiens
  Payload ID: 9721
  Gene Symbol: MSR1
  Gene Name: macrophage scavenger receptor 1
  ENSP ID: ENSP00000430536
EISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLKSRNLTTRKVFAISK

SEQ ID NO: 48019 - protein, 195 aa, Homo sapiens
  Payload ID: 9722
  Gene Symbol: MST1
  Gene Name: macrophage stimulating 1
  ENSP ID: ENSP00000394756
  MOD_RES (1)..(1): Any amino acid
XAGPAFLRGVSSEGAVDTDCPAVLLLLNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 48020 - protein, 725 aa, Homo sapiens
  Payload ID: 9722
  Gene Symbol: MST1
  Gene Name: macrophage stimulating 1
  ENSP ID: ENSP00000414287
MGLWWVTVQPPARRMGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 48021 - protein, 1400 aa, Homo sapiens
  Payload ID: 9723
  Gene Symbol: MST1R
  Gene Name: macrophage stimulating 1 receptor
  Uniprot ID: Q04912
  ENSP ID: ENSP00000296474
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIQGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 48022 - protein, 1351 aa, Homo sapiens
  Payload ID: 9723
  Gene Symbol: MST1R
  Gene Name: macrophage stimulating 1 receptor
  Uniprot ID: Q04912
  ENSP ID: ENSP00000341325
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIQGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 48023 - protein, 285 aa, Homo sapiens
  Payload ID: 9723
  Gene Symbol: MST1R
  Gene Name: macrophage stimulating 1 receptor
  ENSP ID: ENSP00000393294
  MOD_RES (1)..(1): Any amino acid
XQSTLLGILLPLLLLVAALATALVFSYWWRRKQLVLPPNLNDLASLDQTAGATPLPILYSGSDYRSGLGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLP

SEQ ID NO: 48024 - protein, 1032 aa, Homo sapiens
  Payload ID: 9723
  Gene Symbol: MST1R
  Gene Name: macrophage stimulating 1 receptor
  ENSP ID: ENSP00000407926
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIQGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVVRPGPDGVPQSTLLGILLPLLLLVAALATALVFSYWWRRKQLAPHSLSPQHSLPLMVWIPPLVSMEHPSPIVKMNPVCHCCGKSPSS

SEQ ID NO: 48025 - protein, 270 aa, Homo sapiens
  Payload ID: 9723
  Gene Symbol: MST1R
  Gene Name: macrophage stimulating 1 receptor
  ENSP ID: ENSP00000414792
  MOD_RES (1)..(1): Any amino acid
XINVTVGGESCQHEFRGDMVVCPLPPSLQLGQDGAPLQVCVDALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARL

SEQ ID NO: 48026 - protein, 254 aa, Homo sapiens
  Payload ID: 9723
  Gene Symbol: MST1R
  Gene Name: macrophage stimulating 1 receptor
  ENSP ID: ENSP00000481084
MELLPPLPQSFLLLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 48027 - protein, 1294 aa, Homo sapiens
  Payload ID: 9723
  Gene Symbol: MST1R
  Gene Name: macrophage stimulating 1 receptor
  ENSP ID: ENSP00000482642
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPVFQVPIQGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 48028 - protein, 574 aa, Homo sapiens
  Payload ID: 9723
  Gene Symbol: MST1R
  Gene Name: macrophage stimulating 1 receptor
  ENSP ID: ENSP00000482827
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 48029 - protein, 718 aa, Homo sapiens
  Payload ID: 9724
  Gene Symbol: MAD1L1
  Gene Name: MAD1 mitotic arrest deficient-like 1 (yeast)
  Uniprot ID: Q9Y6D9
  ENSP ID: ENSP00000265854
MEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 48030 - protein, 718 aa, Homo sapiens; identical to SEQ ID NO: 48029
  Payload ID: 9724
  Gene Symbol: MAD1L1
  Gene Name: MAD1 mitotic arrest deficient-like 1 (yeast)
  Uniprot ID: Q9Y6D9
  ENSP ID: ENSP00000382562

SEQ ID NO: 48031 - protein, 626 aa, Homo sapiens
  Payload ID: 9724
  Gene Symbol: MAD1L1
  Gene Name: MAD1 mitotic arrest deficient-like 1 (yeast)
  Uniprot ID: Q9Y6D9
  ENSP ID: ENSP00000384155
MLPARGCVRKRTVWPRLARVLIVTLLTLELSYAPLPCQLSGVPYNTGDPVGRWARPCIWPCPWHTTINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 48032 - protein, 718 aa, Homo sapiens; identical to SEQ ID NO: 48029
  Payload ID: 9724
  Gene Symbol: MAD1L1
  Gene Name: MAD1 mitotic arrest deficient-like 1 (yeast)
  Uniprot ID: Q9Y6D9
  ENSP ID: ENSP00000385334

SEQ ID NO: 48033 - protein, 144 aa, Homo sapiens
  Payload ID: 9724
  Gene Symbol: MAD1L1
  Gene Name: MAD1 mitotic arrest deficient-like 1 (yeast)
  ENSP ID: ENSP00000390099
MEDLGENTMVLSTLRSLNNFISQRVEGGSGLDISTSAPGSLQMQYQQSMQREVDRNQELLTRIRQLQEREAGAEEKMQEQLERNRQCQQNLDAASKRLREKEDSLAQAGETINALKGRISELQWSVMDQEMRVKRLESEKQELQ

SEQ ID NO: 48034 - protein, 80 aa, Homo sapiens
  Payload ID: 9724
  Gene Symbol: MAD1L1
  Gene Name: MAD1 mitotic arrest deficient-like 1 (yeast)
  ENSP ID: ENSP00000393037
MRAILGSYDSELTPAEYSPQLTRRMREAEDMVQKVHSHSAEMEAQLSQALEELGGQKQRADMLEMELKMLKSQSSSAEQS

SEQ ID NO: 48035 - protein, 122 aa, Homo sapiens
  Payload ID: 9724
  Gene Symbol: MAD1L1
  Gene Name: MAD1 mitotic arrest deficient-like 1 (yeast)
  ENSP ID: ENSP00000394069
MSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFK

SEQ ID NO: 48036 - protein, 266 aa, Homo sapiens
  Payload ID: 9724
  Gene Symbol: MAD1L1
  Gene Name: MAD1 mitotic arrest deficient-like 1 (yeast)
  ENSP ID: ENSP00000394886
MRELEFAKLECCLAWQLQASRRELEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQ

SEQ ID NO: 48037 - protein, 157 aa, Homo sapiens
  Payload ID: 9724
  Gene Symbol: MAD1L1
  Gene Name: MAD1 mitotic arrest deficient-like 1 (yeast)
  ENSP ID: ENSP00000395457
MEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGE

SEQ ID NO: 48038 - protein, 41 aa, Homo sapiens
  Payload ID: 9724
  Gene Symbol: MAD1L1
  Gene Name: MAD1 mitotic arrest deficient-like 1 (yeast)
  ENSP ID: ENSP00000397417
MRAILGSYDSELTPAEYSPQLTRRMREAEDMVQKVHSHSAE

SEQ ID NO: 48039 - protein, 205 aa, Homo sapiens
  Payload ID: 9724
  Gene Symbol: MAD1L1
  Gene Name: MAD1 mitotic arrest deficient-like 1 (yeast)
  ENSP ID: ENSP00000401901
MQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSI

SEQ ID NO: 48040 - protein, 213 aa, Homo sapiens
  Payload ID: 9724
  Gene Symbol: MAD1L1
  Gene Name: MAD1 mitotic arrest deficient-like 1 (yeast)
  ENSP ID: ENSP00000413139
MQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELE

SEQ ID NO: 48041 - protein, 199 aa, Homo sapiens
  Payload ID: 9724
  Gene Symbol: MAD1L1
  Gene Name: MAD1 mitotic arrest deficient-like 1 (yeast)
  ENSP ID: ENSP00000414877
MVSLRPCLPGLPTQHLEEPCPGDYSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQ

SEQ ID NO: 48042 - protein, 205 aa, Homo sapiens
  Payload ID: 9725
  Gene Symbol: MAD2L1
  Gene Name: MAD2 mitotic arrest deficient-like 1 (yeast)
  Uniprot ID: Q13257
  ENSP ID: ENSP00000296509
MALQLSREQGITLRGSAEIVAEFFSFGINSILYQRGIYPSETFTRVQKYGLTLLVTTDLELIKYLNNVVEQLKDWLYKCSVQKLVVVISNIESGEVLERWQFDIECDKTAKDDSAPREKSQKAIQDEIRSVIRQITATVTFLPLLEVSCSFDLLIYTDKDLVVPEKWEESGPQFITNSEEVRLRSFTTTIHKVNSMVAYKIPVND

SEQ ID NO: 48043 - protein, 90 aa, Homo sapiens
  Payload ID: 9725
  Gene Symbol: MAD2L1
  Gene Name: MAD2 mitotic arrest deficient-like 1 (yeast)
  Uniprot ID: Q13257
  ENSP ID: ENSP00000332295
MALQLSREQGITLRGSAEIVAEFFSFGINSILYQRGIYPSETFTRVQKYGLTLLVTTDLELIKYLNNVVEQLKVHPEKSLRKLSRMKSVQ

SEQ ID NO: 48044 - protein, 41 aa, Homo sapiens
  Payload ID: 9725
  Gene Symbol: MAD2L1
  Gene Name: MAD2 mitotic arrest deficient-like 1 (yeast)
  ENSP ID: ENSP00000425702
MALQLSREQGITLRGSAEIVAEFFLHPEKSLRKLSRMKSVQ

SEQ ID NO: 48045 - protein, 211 aa, Homo sapiens
  Payload ID: 9726
  Gene Symbol: MAD2L2
  Gene Name: MAD2 mitotic arrest deficient-like 2 (yeast)
  Uniprot ID: Q9UI95
  ENSP ID: ENSP00000235310
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 48046 - protein, 211 aa, Homo sapiens; identical to SEQ ID NO: 48045
  Payload ID: 9726
  Gene Symbol: MAD2L2
  Gene Name: MAD2 mitotic arrest deficient-like 2 (yeast)
  Uniprot ID: Q9UI95
  ENSP ID: ENSP00000365855

SEQ ID NO: 48047 - protein, 224 aa, Homo sapiens
  Payload ID: 9726
  Gene Symbol: MAD2L2
  Gene Name: MAD2 mitotic arrest deficient-like 2 (yeast)
  ENSP ID: ENSP00000365857
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSIRWAAPAPRPLAGISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 48048 - protein, 224 aa, Homo sapiens; identical to SEQ ID NO: 48047
  Payload ID: 9726
  Gene Symbol: MAD2L2
  Gene Name: MAD2 mitotic arrest deficient-like 2 (yeast)
  ENSP ID: ENSP00000365860

SEQ ID NO: 48049 - protein, 211 aa, Homo sapiens; identical to SEQ ID NO: 48045
  Payload ID: 9726
  Gene Symbol: MAD2L2
  Gene Name: MAD2 mitotic arrest deficient-like 2 (yeast)
  Uniprot ID: Q9UI95
  ENSP ID: ENSP00000365882

SEQ ID NO: 48050 - protein, 167 aa, Homo sapiens
  Payload ID: 9726
  Gene Symbol: MAD2L2
  Gene Name: MAD2 mitotic arrest deficient-like 2 (yeast)
  ENSP ID: ENSP00000400982
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIK

SEQ ID NO: 48051 - protein, 197 aa, Homo sapiens
  Payload ID: 9726
  Gene Symbol: MAD2L2
  Gene Name: MAD2 mitotic arrest deficient-like 2 (yeast)
  ENSP ID: ENSP00000411807
MTTLTRQDLNFGQGREAGPAGPGAGASGPAGFLERATGLCPPAVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIK

SEQ ID NO: 48052 - protein, 274 aa, Homo sapiens
  Payload ID: 9727
  Gene Symbol: MAD2L1BP
  Gene Name: MAD2L1 binding protein
  Uniprot ID: Q15013
  ENSP ID: ENSP00000361244
MAAPEAEVLSSAAVPDLEWYEKSEETHASQIELLETSSTQEPLNASEAFCPRDCMVPVVFPGPVSQEGCCQFTCELLKHIMYQRQQLPLPYEQLKHFYRKPSPQAEEMLKKKPRATTEVSSRKCQQALAELESVLSHLEDFFARTLVPRVLILLGGNALSPKEFYELDLSLLAPYSVDQSLSTAACLRRLFRAIFMADAFSELQAPPLMGTVVMAQGHRNCGEDWFRPKLNYRVPSRGHKLTVTLSCGRPSIRTTAWEDYIWFQAPVTFKGFRE

SEQ ID NO: 48053 - protein, 306 aa, Homo sapiens
  Payload ID: 9727
  Gene Symbol: MAD2L1BP
  Gene Name: MAD2L1 binding protein
  Uniprot ID: Q15013
  ENSP ID: ENSP00000410818
MARVPLGRSLTLSPRLEHNGMTSAHHNFRLPGSRDSPASASQVAEIIDLEWYEKSEETHASQIELLETSSTQEPLNASEAFCPRDCMVPVVFPGPVSQEGCCQFTCELLKHIMYQRQQLPLPYEQLKHFYRKPSPQAEEMLKKKPRATTEVSSRKCQQALAELESVLSHLEDFFARTLVPRVLILLGGNALSPKEFYELDLSLLAPYSVDQSLSTAACLRRLFRAIFMADAFSELQAPPLMGTVVMAQGHRNCGEDWFRPKLNYRVPSRGHKLTVTLSCGRPSIRTTAWEDYIWFQAPVTFKGFRE

SEQ ID NO: 48054 - protein, 403 aa, Homo sapiens
  Payload ID: 9728
  Gene Symbol: MAEL
  Gene Name: maelstrom spermatogenic transposon silencer
  Uniprot ID: Q96JY0
  ENSP ID: ENSP00000356844
MPNRKASRNAYYFFVQEKIPELRRRGLPVARVADAIPYCSSDWAKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRCKWHEENDILFCALAVCKKIAYCISNSLATLFGIQLTEAHVPLQDYEASNSVTPKMVVLDAGRYQKLRVGSSGFSHFNSSNEEQRSNTPIGDYPSRAKISGQNSSVRGRGITRLLESISNSSSNIHKFSNCDTSLSPYMSQKDGYKSFSSLS

SEQ ID NO: 48055 - protein, 434 aa, Homo sapiens
  Payload ID: 9728
  Gene Symbol: MAEL
  Gene Name: maelstrom spermatogenic transposon silencer
  Uniprot ID: Q96JY0
  ENSP ID: ENSP00000356846
MPNRKASRNAYYFFVQEKIPELRRRGLPVARVADAIPYCSSDWALLREEEKEKYAEMAREWRAAQGKDPGPSEKQKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRCKWHEENDILFCALAVCKKIAYCISNSLATLFGIQLTEAHVPLQDYEASNSVTPKMVVLDAGRYQKLRVGSSGFSHFNSSNEEQRSNTPIGDYPSRAKISGQNSSVRGRGITRLLESISNSSSNIHKFSNCDTSLSPYMSQKDGYKSFSSLS

SEQ ID NO: 48056 - protein, 316 aa, Homo sapiens
  Payload ID: 9728
  Gene Symbol: MAEL
  Gene Name: maelstrom spermatogenic transposon silencer
  ENSP ID: ENSP00000402143
MPNRKASRNAYYFFVQEKIPELRRRGLPVARVADAIPYCSSDWAKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRCKWHEENDILFCALAVCKKIAYCISNSLATLFGIQLTEAHVPLQDYEASNSVTPKMVVLDAGRYQ

SEQ ID NO: 48057 - protein, 378 aa, Homo sapiens
  Payload ID: 9728
  Gene Symbol: MAEL
  Gene Name: maelstrom spermatogenic transposon silencer
  ENSP ID: ENSP00000482771
MAREWRAAQGKDPGPSEKQKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRCKWHEENDILFCALAVCKKIAYCISNSLATLFGIQLTEAHVPLQDYEASNSVTPKMVVLDAGRYQKLRVGSSGFSHFNSSNEEQRSNTPIGDYPSRAKISGQNSSVRGRGITRLLESISNSSSNIHKFSNCDTSLSPYMSQKDGYKSFSSLS

SEQ ID NO: 48058 - protein, 248 aa, Homo sapiens
  Payload ID: 9729
  Gene Symbol: MRO
  Gene Name: maestro
  Uniprot ID: Q9BYG7
  ENSP ID: ENSP00000256425
MDQRQRRILGQPLSIPTSQPKQKRTSMISFFSKVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDITLQTRTLLDDENDSLRYSAFVLFGQLAAFAGRKWKKFFTSQVKQTRDSLLIHLQDRNPQVAKACKTTFQACSPYLKLKEEYSFQSEEDQRNTKLYQQLSHYHPEILQFFYANKIL

SEQ ID NO: 48059 - protein, 248 aa, Homo sapiens; identical to SEQ ID NO: 48058
  Payload ID: 9729
  Gene Symbol: MRO
  Gene Name: maestro
  Uniprot ID: Q9BYG7
  ENSP ID: ENSP00000381465

SEQ ID NO: 48060 - protein, 210 aa, Homo sapiens
  Payload ID: 9729
  Gene Symbol: MRO
  Gene Name: maestro
  Uniprot ID: Q9BYG7
  ENSP ID: ENSP00000392614
MAWGSKGIQGWENLAESSHLATTRESSPPESGTGSGSSRGSRLQEPQVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDITLQTRTLLDDACKTTFQACSPYLKLKEEYSFQSEEDQRNTKLYQQLSHYHPEILQFFYANKIL

SEQ ID NO: 48061 - protein, 262 aa, Homo sapiens
  Payload ID: 9729
  Gene Symbol: MRO
  Gene Name: maestro
  Uniprot ID: Q9BYG7
  ENSP ID: ENSP00000397900
MAWGSKGIQGWENLAESSHLATTRESSPPESGTGSGSSRGSRLQEPQVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDITLQTRTLLDDENDSLRYSAFVLFGQLAAFAGRKWKKFFTSQVKQTRDSLLIHLQDRNPQVAKACKTTFQACSPYLKLKEEYSFQSEEDQRNTKLYQQLSHYHPEILQFFYANKIL

SEQ ID NO: 48062 - protein, 248 aa, Homo sapiens; identical to SEQ ID NO: 48058
  Payload ID: 9729
  Gene Symbol: MRO
  Gene Name: maestro
  Uniprot ID: Q9BYG7
  ENSP ID: ENSP00000409509

SEQ ID NO: 48063 - protein, 196 aa, Homo sapiens
  Payload ID: 9729
  Gene Symbol: MRO
  Gene Name: maestro
  Uniprot ID: Q9BYG7
  ENSP ID: ENSP00000465653
MDQRQRRILGQPLSIPTSQPKQKRTSMISFFSKVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDITLQTRTLLDDACKTTFQACSPYLKLKEEYSFQSEEDQRNTKLYQQLSHYHPEILQFFYANKIL

SEQ ID NO: 48064 - protein, 110 aa, Homo sapiens
  Payload ID: 9729
  Gene Symbol: MRO
  Gene Name: maestro
  ENSP ID: ENSP00000465783
MAWGSKGIQGWENLAESSHLATTRESSPPESGTGSGSSRGSRLQEPQFHGPKTEENPGPAPFHPYFPAQAEKDINDIFLFQGLLETEVPEAGASEECVFHLGRKSSGPQC

SEQ ID NO: 48065 - protein, 47 aa, Homo sapiens
  Payload ID: 9729
  Gene Symbol: MRO
  Gene Name: maestro
  ENSP ID: ENSP00000466218
MDQRQRRILGQPLSIPTSQPKQKRTSMISFFSKKELGTPVLKSVTWQ

SEQ ID NO: 48066 - protein, 179 aa, Homo sapiens
  Payload ID: 9729
  Gene Symbol: MRO
  Gene Name: maestro
  ENSP ID: ENSP00000467427
MDQRQRRILGQPLSIPTSQPKQKRTSMISFFSKVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDITLQTRTLLDDACKTTFQACSPYLKLKEEYSFQSEEDQRNTKLYQQL

SEQ ID NO: 48067 - protein, 248 aa, Homo sapiens; identical to SEQ ID NO: 48058
  Payload ID: 9729
  Gene Symbol: MRO
  Gene Name: maestro
  Uniprot ID: Q9BYG7
  ENSP ID: ENSP00000482576

SEQ ID NO: 48068 - protein, 1641 aa, Homo sapiens
  Payload ID: 9730
  Gene Symbol: MROH1
  Gene Name: maestro heat-like repeat family member 1
  Uniprot ID: Q8NDA8
  ENSP ID: ENSP00000321737
MTESSMKKLASTLLDAITDKDPLVQEQVCSALCSLGEARPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAAAQMEDKKPFILSSMRLPLLDTNSKVKRAVVQVISAMAHHGYLEQPGGEAMIEYIVQQCALPPEQEPEKPGPGSKDPKADSVRAISVRTLYLVSTTVDRMSHVLWPYLLQFLTPVRFTGALTPLCRSLVHLAQKRQEAGADAFLIQYDAHASLPSPYAVTGRLLVVSSSPYLGDGRGAAALRLLSVLHPNIHPLLGQHWETTVPLLLGYLDEHTEETLPQEEWEEKLLMFLRDTLAIISDNAWICQLSLELCRQLPCYDEAPQEKNFLYKCIGTTLGAASSKEVVRKHLQELLETARYQEEAEREGLACCFGICAISHLEDTLAQLEDFVRSEVFRKSIGILNIFKDRSENEVEKVKSALILCYGHVAARAPRELVLAKVESDILRNICQHFSTKVLGIKVETKDPALKLCLVQSVCMVSRAICSSTQAGSFHFTRKAELVAQMMEFIRAEPPDSLRTPIRKKAMLTCTYLVSVEPALDEQARADVIHGCLHSIMALLPEPKEEDGGCQKSLYLETLHALEDLLTSLLQRNMTPQGLQIMIEHLSPWIKSPRGHERARALGLSALLLRYFLEHLRVSALVPFHNLGLLIGLFSPRCADLWPATRQEAVDCVYSLLYLQLGYEGFSRDYRDDVAERLLSLKDGLVHPDPAILFHTCHSVGQIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYPQLFVVLLLRVSCTVGVQLPRNLQAQERRGASPALATRNLEPCSSAVDTLRSMLLRSGSEDVVQRMDLEGGWELLRTSAGHEEGATRLARAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGFLVLHSEPRQQPQVDLDQLIAALQILLKDPAPEVRTRAAEALGRLVKLA

SEQ ID NO: 48069 - protein, 422 aa, Homo sapiens
  Payload ID: 9730
  Gene Symbol: MROH1
  Gene Name: maestro heat-like repeat family member 1
  Uniprot ID: Q8NDA8
  ENSP ID: ENSP00000388174
MTESSMKKLASTLLDAITDKDPLVQEQVCSALCSLGEARPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAGSTNTRITLMLPSAVTRLKHEDCPARAAPQPADLTAAPASVA

SEQ ID NO: 48070 - protein, 1641 aa, Homo sapiens; identical to SEQ ID NO: 48068
  Payload ID: 9730
  Gene Symbol: MROH1
  Gene Name: maestro heat-like repeat family member 1
  Uniprot ID: Q8NDA8
  ENSP ID: ENSP00000435565

SEQ ID NO: 48071 - protein, 1632 aa, Homo sapiens
  Payload ID: 9730
  Gene Symbol: MROH1
  Gene Name: maestro heat-like repeat family member 1
  ENSP ID: ENSP00000436636
MTESSMKKLASTLLDAITDKDPLVQEQVCSALCSLGEARPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAAAQMEDKKPFILSSMRLPLLDTNSKVKRAVVQVISAMAHHGYLEQPGGEAMIEYIVQQCALPPEQEPEKPGPGSKDPKADSVRAISVRTLYLVSTTVDRMSHVLWPYLLQFLTPVRFTGALTPLCRSLVHLAQKRQEAGADAFLIQYDAHASLPSPYAVTGRLLVVSSSPYLGDGRGAAALRLLSVLHPNIHPLLGQHWETTVPLLLGYLDEHTEETLPQEEWEEKLLMFLRDTLAIISDNAWICQLSLELCRQLPCYDEAPQEKNFLYKCIGTTLGAASSKEVVRKHLQELLETARYQEEAEREGLACCFGICAISHLEDTLAQLEDFVRSEVFRKSIGILNIFKDRSENEVEKVKSALILCYGHVAARAPRELVLAKVESDILRNICQHFSTKDPALKLCLVQSVCMVSRAICSSTQAGSFHFTRKAELVAQMMEFIRAEPPDSLRTPIRKKAMLTCTYLVSVEPALDEQARADVIHGCLHSIMALLPEPKEEDGGCQKSLYLETLHALEDLLTSLLQRNMTPQGLQIMIEHLSPWIKSPRGHERARALGLSALLLRYFLEHLRVSALVPFHNLGLLIGLFSPRCADLWPATRQEAVDCVYSLLYLQLGYEGFSRDYRDDVAERLLSLKDGLVHPDPAILFHTCHSVGQIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYPQLFVVLLLRVSCTVGVQLPRNLQAQERRGASPALATRNLEPCSSAVDTLRSMLLRSGSEDVVQRMDLEGGWELLRTSAGHEEGATRLARAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGFLVLHSEPRQQPQVDLDQLIAALQILLKDPAPEVRTRAAEALGRLVKLA

SEQ ID NO: 48072 - protein, 615 aa, Homo sapiens
  Payload ID: 9730
  Gene Symbol: MROH1
  Gene Name: maestro heat-like repeat family member 1
  Uniprot ID: Q8NDA8
  ENSP ID: ENSP00000437866
MRIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYPQLFVVLLLRVSCTVGVQLPRNLQAQERRGASPALATRNLEPCSSAVDTLRSMLLRSGSEDVVQRMDLEGGWELLRTSAGHEEGATRLARAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGKHHPLPHPHAARQPRLMPPLHRVPGAALGAQAAAAGGPGPAHCGAPDPAEGPGPRGADEGC

SEQ ID NO: 48073 - protein, 1674 aa, Homo sapiens
  Payload ID: 9731
  Gene Symbol: MROH2A
  Gene Name: maestro heat-like repeat family member 2A
  Uniprot ID: A6NES4
  ENSP ID: ENSP00000374408
MTEAITEAAVASSEEVSEERDDLGPLELHDSGTFQQVVNLLDIIDSESAKTDTTGAGLDMRKTLASVIIMEKATTEPSVVINTLIRCLQVPEISTQRKVNIYNILQDIIQQEGELEEQCVQRLVAIASKEMREIPEMEGYMKAEVASDTLVALSRNHFSLVMYELQHHLKPLNLTDEFVIITLAKLANGNVFEFMPYMGITLATIFTMLRLANEAKIRQAICSAMETFCETVQFYLKHLEESVYPVMTEEEFALKVFPMYRYFVTVWLRHYNPEVKLGVIKSLKPMLGLLLPNDDLREQVYDYIPLLLAEYQGSLEVLFVTQVLRQILELSVTTNTPVPQMQLHTIFTELHVQVCNKAPAQHQYSSQNLMEMVHCFVALARSYPKELMKFFFSQMETNKEAVRVGTLNLIRAIVSADEPRMSIRAIYLAIRVVKNTISDTRSKVRMAILHIIGQLALCGYQERIKGWGLKYLSVQLTLSTYKLTNRREKFYQRDLEERMVHKVTMDTVKIITSSVSGMTTEFWVRLLCYIMETDYVEALTPICISLTNLAEHQLHGQDVDVSVAGKSRQVDLPAPQKLLARLLVLMSSPYKGEGRGIAMLNLLRTLSQSIAPSMADMWELEIALLVRYLEEHTEFTWDQKAWEDKLIQFLRNSLKKTRGSSWSLRLSKELNNQIASFDSPSLEKGFLYRALGFTLATGLEASKVEVLLLELLYKTDYSNDFDSEGVIMCFGLCARGQVKTVLNVLHDFEERIQESEQSWQISAWRKDHPWRRETVKSALMVMYSCVASYCHPQLLLNLVDSPITAKIIHHYVSSCQDICLKMAFMKSVVQVTKAINNIKDLEDFHFAQKTTLTSIIVAVIKAEPTDNLVSPVRALAMEALSHLSKLKPFYSTEENSELMDISIHSVISLQLPGEDNESIKTLYANALSSLEQLMESLLQRQLDPKGLQEMVQLLEKWILSEKEWEREKAVSLHLYLMWIYVHSTAVCIHLKLGQFGTMVGLIAPCTCDAHQRTRMASMNVLSSLLDLHASQTCSLWGPSKQKELEKCKGDLQSTDVEKIFCASSRIAKVVCMEFSCDEVVSLIQKLCENTGAMNLQHDKASVTWIAFFLQMRAKELEDKVAEILSAILVHLPVVDHPEVRRLLIDGILLLAHHHQETILTSLLRQPLPMESHLAEVWLAVSENVPFARTMLHSLMGRLQSRLSPRISATSKADIWRLAAVDPLMTLCTIHLLIQKLDENDKLPDFLPDLIYTLLLQLGSSHRPEAAPPVLKMWKLVHTTPLPEEMNLQRVTIKSMQLLFKRVKSQHLAHTLDEQAVWDLLQDGGTFLEGVSLLARLCMQHVEGHRQRLAELVLRGMDSEVLSCRISSTAVCFMSGPVLYQEKLLKPAALLLEKGADQEEDEALRVLSLRALGNMALGAPKKVKQYRKVLLEKCLGPLREPVSNSVTAEGMEALTKILAELREGDVGSSFDAMSEQCRIFFDNESELLRLKAFILFGKLARVVGMSKKHFFKGEVKKAWIPLMLHSQDPCSNAAQACMATMFQCVHFWGWKSLEHPSGPSDTATDDKMTVFQTTMCSILTRKKPAVLYRFLLETMAYVKNNLSRIRIAACNLAGIIMKQMSTHYLKKLDFPALRNSLQELQLDPDPGVRRAALETLTVLDSCSQHGFLASPQGMS

SEQ ID NO: 48074 - protein, 68 aa, Homo sapiens
  Payload ID: 9731
  Gene Symbol: MROH2A
  Gene Name: maestro heat-like repeat family member 2A
  ENSP ID: ENSP00000392128
MTEAITEAAVASSEEVSEERDDLGPLELHDSGTFQQVVNLLDIIDSESAKTDTTGAGLDMRKTLASVI

SEQ ID NO: 48075 - protein, 68 aa, Homo sapiens; identical to SEQ ID NO: 48074
  Payload ID: 9731
  Gene Symbol: MROH2A
  Gene Name: maestro heat-like repeat family member 2A
  ENSP ID: ENSP00000404614

SEQ ID NO: 48076 - protein, 9 aa, Homo sapiens
  Payload ID: 9731
  Gene Symbol: MROH2A
  Gene Name: maestro heat-like repeat family member 2A
  ENSP ID: ENSP00000409355
MRKTLASVI

SEQ ID NO: 48077 - protein, 1688 aa, Homo sapiens
  Payload ID: 9731
  Gene Symbol: MROH2A
  Gene Name: maestro heat-like repeat family member 2A
  ENSP ID: ENSP00000477597
MTEAITEAAVASSEEVSEERDDLGPLELHDSGTFQQVVNLLDIIDSESAKTDTTGAGLDMRKTLASVIIMEKATTEPSVVINTLIRCLQVPEISTQRKVNIYNILQDIIQQEGELEEQCVQRLVAIASKEMREIPEMEGYMKAEVASDTLVALSRNHFSLVMYELQHHLKPLNLTDEFVIITLAKLANGNVFEFMPYMGITLATIFTMLRLANEAKIRQAICSAMETFCETVQFYLKHLEESVYPVMTEEEFALKVFPMYRYFVTVWLRHYNPEVKLGVIKSLKPMLGLLLPNDDLREQVYDYIPLLLAEYQGKGHLPPFANPLQVLRQILELSVTTNTPVPQMQLHTIFTELHVQVCNKAPAQHQYSSQNLMEMVHCFVALARSYPKELMKFFFSQMETNKEAVRVGTLNLIRAIVSADEPRMSIRAIYLAIRVVKNTISDTRSKVRMAILHIIGQLALCGYQERIKGWGLKYLSVQLTLSTYKLTNRREKFYQRDLEERMVHKVTMDTVKIITSSVSGMTTEFWVRLLCYIMETDYVEALTPICISLTNLAEHQLHGQDVDVSVAGKSRQVDLPAPQKLLARLLVLMSSPYKGEGRGIAMLNLLRTLSQSIAPSMADMWELEIALLVRYLEEHTEFTWDQKAWEDKLIQFLRNSLKKTRGSSWSLRLSKELNNQIASFDSPSLEKGFLYRALGFTLATGLEASKVEVLLLELLYKTDYSNDFDSEGVIMCFGLCARGQVKTVLNVLHDFEERIQESEQSWQISAWRKDHPWRRETVKSALMVMYSCVASYCHPQLLLNLVDSPITAKIIHHYVSSCQDICLKMAFMKSVVQVTKAINNIKDLEDFHFAQKTTLTSIIVAVIKAEPTDNLVSPVRALAMEALSHLSKLKPFYSTEENSELMDISIHSVISLQLPGEDNESIKTLYANALSSLEQLMESLLQRQLDPKGLQEMVQLLEKWILSEKEWEREKAVSLHLYLMWIYVHSTAVCIHLKLGQFGTMVGLIAPCTCDAHQRTRMASMNVLSSLLDLHASQTCSLWGPSKQKELEKCKGDLQSTDVEKIFCASSRIAKVVCMEFSCDEVVSLIQKLCENTGAMNLQHDKASVTWIAFFLQMRAKELEDKVAEILSAILVHLPVVDHPEVRRLLIDGILLLAHHHQETILTSLLRQPLPMESHLAEVWLAVSENVPFARTMLHSLMGRLQSRLSPRISATSKADIWRLAAVDPLMTLCTIHLLIQKLDENDKLPDFLPDLIYTLLLQLGSSHRPEAAPPVLKMWKLVHTTPLPEEMNLQRCSRGRVTIKSMQLLFKRVKSQHLAHTLDEQAVWDLLQDGGTFLEGVSLLARLCMQHVEGHRQRLAELVLRGMDSEVLSCRISSTAVCVEMRHRFMSGPVLYQEKLLKPAALLLEKGADQEEDEALRVLSLRALGNMALGAPKKVKQYRKVLLEKCLGPLREPVSNSVTAEGMEALTKILAELREGDVGSSFDAMSEQCRIFFDNESELLRLKAFILFGKLARVVGMSKKHFFKGEVKKAWIPLMLHSQDPCSNAAQACMATMFQCVHFWGWKSLEHPSGPSDTATDDKMTVFQTTMCSILTRKKPAVLYRFLLETMAYVKNNLSRIRIAACNLAGIIMKQMSTHYLKKLDFPALRNSLQELQLDPDPGVRRAALETLTVLDSCSQHGFLASPQGMS

SEQ ID NO: 48078 - protein, 1585 aa, Homo sapiens
  Payload ID: 9732
  Gene Symbol: MROH2B
  Gene Name: maestro heat-like repeat family member 2B
  Uniprot ID: Q7Z745
  ENSP ID: ENSP00000382476
MTLSTEESIEMFGDINLTLGMLNKEDIVNKEDIYSHLTSVIQNTDILDDAIVQRLIYYASKDMRDNNMLREIRMLAGEVLVSLAAHDFNSVMYEVQSNFRILELPDEFVVLALAELATSYVSQSIPFMMMTLLTMQTMLRLAEDERMKGTFCIALEKFSKAIYKYVNHWRDFPYPRLDANRLSDKIFMLFWYIMEKWAPLASPMQTLSIVKAHGPTVSLLLHREDFRGYALGQVPWLLNQYKDKEIDFHVTQSLKQILTAAVLYDIGLPRSLRRSIFINLLQQICRAPEPPVKENEMKASSCFLILAHSNPGELMEFFDEQVRSNNEAIRVGILTLLRLAVNADEPRLRDHIISIERTVKIVMGDLSTKVRNSVLLLIQTMCEKSYIEAREGWPLIDYVFSQFATLNRNLEKPVKTNFHENEKEEESVRETSLEVLKTLDPLVIGMPQVLWPRILTFVVPAEYTEALEPLFSIIRILIMAEEKKQHSAKESTALVVSTGAVKLPSPQQLLARLLVISMPASLGELRGAGAIGLLKILPEIIHPKLVDLWKTRLPELLQPLEGKNISTVLWETMLLQLLKESLWKISDVAWTIQLTQDFKQQMGSYSNNSTEKKFLWKALGTTLACCQDSDFVNSQIKEFLTAPNQLGDQRQGITSILGYCAENHLDIVLKVLKTFQNQEKFFMNRCKSLFSGKKSLTKTDVMVIYGAVALHAPKKQLLSRLNQDIISQVLSLHGQCSQVLGMSVMNKDMDLQMSFTRSITEIGIAVQDAEDQGFQFSYKEMLIGYMLDFIRDEPLDSLASPIRWKALIAIRYLSKLKPQLSLQDHLNILEENIRRLLPLPPLENLKSEGQTDKDKEHIQFLYERSMDALGKLLKTMMWDNVNAEDCQEMFNLLQMWLVSQKEWERERAFQITAKVLTNDIEAPENFKIGSLLGLLAPHSCDTLPTIRQAAASSTIGLFYIKGIHLEVERLQGLQEGLESDDVQVQIKISSKIAKIVSKFIPNEEILMFLEEMLDGLESLNPTCTKACGIWMITVLKQQGAALEDQLLEILGTIYHHMPVLRQKEESFQFILEAISQIASFHMDTVVVNLLQKPLPFDRDTKTLWKALAEKPASSGKLLQALIDKLETELEDDIARVEAISVACAMYEVISMGTSVTGLYPELFTLLLKLVSCTLGQKMLTCPWSHRRHVMQQGEQQQIPDPCRLSTATLKCLQAQAMREGLAKESDEGDNLWTLLSSPSTHHIGVCSLARSMAVWQHGVILDIMEQLLSSLTSSSENYRITGAAFFSELMKEPILWKHGNLRNVLILMDQSAWDSNATLRQMAIRGLGNTASGAPHKVKKHKQLMLESIIRGLYHLARTEVVCESLKALKKILELLTDRDVSFYFKEIVLQTRTFFEDEQDDVRLTAIFLFEDLAPLTGRRWKIFFAEEIKKSLISFLLHLWDPNPKIGVACRDVLMVCIPFLGLQELYGVLDRLLDQDLPRARDFYRQFCVKLAKKNQEILWILHTHSFTFFTSTWEVIRSAAVKLTDAVVLNLTSQYVELLDREQLTTRLQALRQDPCISVQRAAEAALQTLLRRCKETSIPL

SEQ ID NO: 48079 - protein, 1140 aa, Homo sapiens
  Payload ID: 9732
  Gene Symbol: MROH2B
  Gene Name: maestro heat-like repeat family member 2B
  ENSP ID: ENSP00000441504
MPQVLWPRILTFVVPAEYTEALEPLFSIIRILIMAEEKKQHSAKESTALVVSTGAVKLPSPQQLLARLLVISMPASLGELRGAGAIGLLKILPEIIHPKLVDLWKTRLPELLQPLEGKNISTVLWETMLLQLLKESLWKISDVAWTIQLTQDFKQQMGSYSNNSTEKKFLWKALGTTLACCQDSDFVNSQIKEFLTAPNQLGDQRQGITSILGYCAENHLDIVLKVLKTFQNQEKFFMNRCKSLFSGKKSLTKTDVMVIYGAVALHAPKKQLLSRLNQDIISQVLSLHGQCSQVLGMSVMNKDMDLQMSFTRSITEIGIAVQDAEDQGFQFSYKEMLIGYMLDFIRDEPLDSLASPIRWKALIAIRYLSKLKPQLSLQDHLNILEENIRRLLPLPPLENLKSEGQTDKDKEHIQFLYERSMDALGKLLKTMMWDNVNAEDCQEMFNLLQMWLVSQKEWERERAFQITAKVLTNDIEAPENFKIGSLLGLLAPHSCDTLPTIRQAAASSTIGLFYIKGIHLEVERLQGLQEGLESDDVQVQIKISSKIAKIVSKFIPNEEILMFLEEMLDGLESLNPTCTKACGIWMITVLKQQGAALEDQLLEILGTIYHHMPVLRQKEESFQFILEAISQIASFHMDTVVVNLLQKPLPFDRDTKTLWKALAEKPASSGKLLQALIDKLETELEDDIARVEAISVACAMYEVISMGTSVTGLYPELFTLLLKLVSCTLGQKMLTCPWSHRRHVMQQGEQQQIPDPCRLSTATLKCLQAQAMREGLAKESDEGDNLWTLLSSPSTHHIGVCSLARSMAVWQHGVILDIMEQLLSSLTSSSENYRITGAAFFSELMKEPILWKHGNLRNVLILMDQSAWDSNATLRQMAIRGLGNTASGAPHKVKKHKQLMLESIIRGLYHLARTEVVCESLKALKKILELLTDRDVSFYFKEIVLQTRTFFEDEQDDVRLTAIFLFEDLAPLTGRRWKIFFAEEIKKSLISFLLHLWDPNPKIGVACRDVLMVCIPFLGLQELYGVLDRLLDQDLPRARDFYRQFCVKLAKKNQEILWILHTHSFTFFTSTWEVIRSAAVKLTDAVVLNLTSQYVELLDREQLTTRLQALRQDPCISVQRAAEAALQTLLRRCKETSIPL

SEQ ID NO: 48080 - protein, 39 aa, Homo sapiens
  Payload ID: 9733
  Gene Symbol: MROH5
  Gene Name: maestro heat-like repeat family member 5
  ENSP ID: ENSP00000427945
MDRQCSERPYSCTPTGRVSSAVSQNSSHRLQDAAGHEQC

SEQ ID NO: 48081 - protein, 39 aa, Homo sapiens; identical to SEQ ID NO: 48080
  Payload ID: 9733
  Gene Symbol: MROH5
  Gene Name: maestro heat-like repeat family member 5
  ENSP ID: ENSP00000429433

SEQ ID NO: 48082 - protein, 110 aa, Homo sapiens
  Payload ID: 9733
  Gene Symbol: MROH5
  Gene Name: maestro heat-like repeat family member 5
  ENSP ID: ENSP00000429440
MKDSSCMKVHQDSARRDRWSHPTTILLHKSQSSQATLMLQEHRMFMGEAYSAATGFKMLQDMNSADPFHLKYIIKKIKNMAHGSPKLVMETIHDYFIDNPEISSRHKFRL

SEQ ID NO: 48083 - protein, 1317 aa, Homo sapiens
  Payload ID: 9733
  Gene Symbol: MROH5
  Gene Name: maestro heat-like repeat family member 5
  ENSP ID: ENSP00000431031
MDRQCSERPYSCTPTGRVSSAVSQNSRISPPVSTSMKDSSCMKVHQDSARRDRWSHPTTILLHKSQSSQATLMLQEHRMFMGEAYSAATGFKMLQDMNSADPFHLKYIIKKIKNMAHGSPKLVMETIHDYFIDNPEISSRHKFRLFQTLEMVIGASDVLEETWEKTFTRLALENMTKATELEDIYQDAASNMLVAICRHSWRVVAQHLETELLTGVFPHRSLLYVMGVLSSSEELFSQEDKACWEEQLIQMAIKSVPFLSTDVWSKELLWTLTTPSWTQQEQSPEKAFLFTYYGLILQAEKNGATVRRHLQALLETSHQWPKQREGMALTLGLAATRHLDDVWAVLDQFGRSRPIRWSLPSSSPKNSEDLRWKWASSTILLAYGQVAAKARAHILPWVDNIVSRMVFYFHYSSWDETLKQSFLTATLMLMGAVSRSEGAHSYEFFQTSELLQCLMVLMEKEPQDTLCTRSRQQAMHIASSLCKLRPPIDLERKSQLLSTCFRSVFALPLLDALEKHTCLFLEPPNIQLWPVARERAGWTHQGWGPRAVLHCSEHLQSLYSRTMEALDFMLQSLIMQNPTADELHFLLSHLYIWLASEKAHERQRAVHSCMILLKFLNHNGYLDPKEDFKRIGQLVGILGMLCQDPDRATQRCSLEGASHLYQLLMCHKTGEALQAESQAPKELSQAHSDGAPLWNSRDQKATPLGPQEMAKNHIFQLCSFQVIKDIMQQLTLAELSDLIWTAIDGLGSTSPFRVQAASEMLLTAVQEHGAKLEIVSSMAQAIRLRLCSVHIPQAKEKTLHAITLLARSHTCELVATFLNISIPLDSHTFQLWRALGAGQPTSHLVLTTLLACLQERPLPTGASDSSPCPKEKTYLRLLAAMNMLHELQFAREFKQAVQEGYPKLFLALLTQMHYVLELNLPSEPPKQQAQEAAVPSPQSCSTSLEALKSLLSTTGHWHDFAHLELQGSWELFTTIHTYPKGVGLLARAMVQNHCRQIPAVLRQLLPSLQSPQERERKVAILILTKFLYSPVLLEVLPKQAALTVLAQGLHDPSPEVRVLSLQGLSNILFHPDKGSLLQGQLRPLLDGFFQSSDQVIVCIMGTVSDTLHRLGAQGTGSQSLGVAISTRSFFNDERDGIRAAAMALFGDLVAAMADRELSGLRTQVHQSMVPLLLHLKDQCPAVATQAKFTFYRCAVLLRWRLLHTLFCTLAWERGLSARHFLWTCLMTRSQEEFSIHLSQALSYLHSHSCHIKTWVTLFIGHTICYHPQAVFQMLNAVDTNLLFRTFEHLRSDPEPSIREFATSQLSFLQKVSARPKQ

SEQ ID NO: 48084 - protein, 1317 aa, Homo sapiens; identical to SEQ ID NO: 48083
  Payload ID: 9733
  Gene Symbol: MROH5
  Gene Name: maestro heat-like repeat family member 5
  ENSP ID: ENSP00000481783

SEQ ID NO: 48085 - protein, 492 aa, Homo sapiens
  Payload ID: 9733
  Gene Symbol: MROH5
  Gene Name: maestro heat-like repeat family member 5
  ENSP ID: ENSP00000487596
  MOD_RES (1)..(1): Any amino acid
XHTFQLWRALGAGQPTSHLVLTTLLACLQERPLPTGASDSSPCPKEKTYLRLLAAMNMLHELQFAREFKQAVQEGYPKLFLALLTQMHYVLELNLPSEPPKQQAQEAAVPSPQSCSTSLEALKSLLSTTGHWHDFAHLELQGSWELFTTIHTYPKGVGLLARAMVQNHCRQIPAVLRQLLPSLQSPQERERKVAILILTKFLYSPVLLEVLPKQAALTVLAQGLHDPSPEVRVLSLQGLSNILFHPDKGSLLQGQLRPLLDGFFQSSDQVIVCIMGTVSDTLHRLGAQGTGSQSLGVAISTRSFFNDERDGIRAAAMALFGDLVAAMADRELSGLRTQVHQSMVPLLLHLKDQCPAVATQAKFTFYRCAVLLRWRLLHTLFCTLAWERGLSARHFLWTCLMTRSQEEFSIHLSQALSYLHSHSCHIKTWVTLFIGHTICYHPQAVFQMLNAVDTNLLFRTFEHLRSDPEPSIREFATSQLSFLQKVSARPKQ

SEQ ID NO: 48086 - protein, 719 aa, Homo sapiens
  Payload ID: 9734
  Gene Symbol: MROH6
  Gene Name: maestro heat-like repeat family member 6
  Uniprot ID: A6NGR9
  ENSP ID: ENSP00000381857
MAGGVWGRSRAREAPVGALTLTALTEGIRARQGQPQGPPSAGPQPKSWEVKPEAEPQTQALTAPSEAEPGRGATVPEAGSEPCSLNSALEPAPEGPHQVPQSSWEEGVLADLALYTAACLEEAGFAGTQATVLTLSSALEARGERLEDQVHALVRGLLAQVPSLAEGRPWRAALRVLSALALEHARDVVCALLPRSLPADRVAAELWRSLSRNQRVNGQVLVQLLWALKGASGPEPQALAATRALGEMLAVSGCVGATRGFYPHLLLALVTQLHKLARSPCSPDMPKIWVLSHRGPPHSHASCAVEALKALLTGDGGRMVVTCMEQAGGWRRLVGAHTHLEGVLLLASAMVAHADHHLRGLFADLLPRLRSADDPQRLTAMAFFTGLLQSRPTARLLREEVILERLLTWQGDPEPTVRWLGLLGLGHLALNRRKVRHVSTLLPALLGALGEGDARLVGAALGALRRLLLRPRAPVRLLSAELGPRLPPLLDDTRDSIRASAVGLLGTLVRRGRGGLRLGLRGPLRKLVLQSLVPLLLRLHDPSRDAAESSEWTLARCDHAFCWGLLEELVTVAHYDSPEALSHLCCRLVQRYPGHVPNFLSQTQGYLRSPQDPLRRAAAVLIGFLVHHASPGCVNQDLLDSLFQDLGRLQSDPKPAVAAAAHVSAQQVAMLARARGCPRGPRLLRIAPRPARPPPVFADSPFQRRSVAGRWGCSGPRRA

SEQ ID NO: 48087 - protein, 50 aa, Homo sapiens
  Payload ID: 9734
  Gene Symbol: MROH6
  Gene Name: maestro heat-like repeat family member 6
  ENSP ID: ENSP00000431569
MLARARGCPRGPRLLRIAPRPARPPPVFADSPFQRRSVAGRWGCSGPRRA

SEQ ID NO: 48088 - protein, 50 aa, Homo sapiens; identical to SEQ ID NO: 48087
  Payload ID: 9734
  Gene Symbol: MROH6
  Gene Name: maestro heat-like repeat family member 6
  ENSP ID: ENSP00000434244

SEQ ID NO: 48089 - protein, 50 aa, Homo sapiens; identical to SEQ ID NO: 48087
  Payload ID: 9734
  Gene Symbol: MROH6
  Gene Name: maestro heat-like repeat family member 6
  ENSP ID: ENSP00000435528

SEQ ID NO: 48090 - protein, 6 aa, Homo sapiens
  Payload ID: 9734
  Gene Symbol: MROH6
  Gene Name: maestro heat-like repeat family member 6
  ENSP ID: ENSP00000436284
MLARAR

SEQ ID NO: 48091 - protein, 548 aa, Homo sapiens
  Payload ID: 9734
  Gene Symbol: MROH6
  Gene Name: maestro heat-like repeat family member 6
  ENSP ID: ENSP00000436959
MAGGVWGRSRAREAPVGALTLTALTEGIRARQGQPQGPPSAGPQPKSWEVKPEAEPQTQALTAPSEAEPGRGATVPEAGSEPCSLNSALEPAPEGPHQVPQSSWEEGVLADLALYTAACLEEAGFAGTQATVLTLSSALEARGERLEDQVHALVRGLLAQVPSLAEGRPWRAALRVLSALALEHARDVVCALLPRSLPADRVAAELWRSLSRNQRVNGQVLVQLLWALKGASGPEPQALAATRALGEMLAVSGCVGATRGFYPHLLLALVTQLHKLARSPCSPDMPKIWVLSHRGPPHSHASSHCPPAHCPHHQLCCGGLEGAAHRGWRPHGGHVHGAGRRLEEAGGSPHPPGGRPAAGQCYGGTCRPPPARPLRRLAPSASQRGRPAASHGYGLLHRAVAEPAHRTAPAGGGHPGATPHLAGRPRTHCALVGPAGPGPPRAESQEGAAREHAAAGAPGRTGRRRRAARGCSAGRPEEAPAAAPGACAAPERGAGTAPPSATGRHTGLNPRLGRRAPWDSGAPGPGRAPAGAPRPPAEAGAAESRAAA

SEQ ID NO: 48092 - protein, 719 aa, Homo sapiens; identical to SEQ ID NO: 48086
  Payload ID: 9734
  Gene Symbol: MROH6
  Gene Name: maestro heat-like repeat family member 6
  Uniprot ID: A6NGR9
  ENSP ID: ENSP00000479227

SEQ ID NO: 48093 - protein, 548 aa, Homo sapiens; identical to SEQ ID NO: 48091
  Payload ID: 9734
  Gene Symbol: MROH6
  Gene Name: maestro heat-like repeat family member 6
  ENSP ID: ENSP00000488703

SEQ ID NO: 48094 - protein, 1044 aa, Homo sapiens
  Payload ID: 9735
  Gene Symbol: MROH7
  Gene Name: maestro heat-like repeat family member 7
  ENSP ID: ENSP00000343211
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHEPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVEQPCEEGIVILMLRISWERQQQAVTGARSWRVTHSALPHGADGHQTETSSNLLVLQV

SEQ ID NO: 48095 - protein, 1030 aa, Homo sapiens
  Payload ID: 9735
  Gene Symbol: MROH7
  Gene Name: maestro heat-like repeat family member 7
  Uniprot ID: Q68CQ1
  ENSP ID: ENSP00000379044
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHEPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVEQPCEEGIVILMLRPQDLMGKATTSSHRGSELESDTLSFATWC

SEQ ID NO: 48096 - protein, 891 aa, Homo sapiens
  Payload ID: 9735
  Gene Symbol: MROH7
  Gene Name: maestro heat-like repeat family member 7
  ENSP ID: ENSP00000387048
MALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVELLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREVVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 48097 - protein, 627 aa, Homo sapiens
  Payload ID: 9735
  Gene Symbol: MROH7
  Gene Name: maestro heat-like repeat family member 7
  Uniprot ID: Q68CQ1
  ENSP ID: ENSP00000388181
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHEPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFIAIQTDALGVPGAGASAGETHPSHWGS

SEQ ID NO: 48098 - protein, 627 aa, Homo sapiens; identical to SEQ ID NO: 48097
  Payload ID: 9735
  Gene Symbol: MROH7
  Gene Name: maestro heat-like repeat family member 7
  Uniprot ID: Q68CQ1
  ENSP ID: ENSP00000394373

SEQ ID NO: 48099 - protein, 1323 aa, Homo sapiens
  Payload ID: 9735
  Gene Symbol: MROH7
  Gene Name: maestro heat-like repeat family member 7
  Uniprot ID: Q68CQ1
  ENSP ID: ENSP00000396622
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHEPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVELLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREVVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 48100 - protein, 70 aa, Homo sapiens
  Payload ID: 9735
  Gene Symbol: MROH7
  Gene Name: maestro heat-like repeat family member 7
  ENSP ID: ENSP00000399703
MALVENVTTLQKSQDLLEAEGEKKTMIKKIMPHPAHPGHAGEVGAGERVCAQRVLPALRAGDAGEGRGQG

SEQ ID NO: 48101 - protein, 754 aa, Homo sapiens
  Payload ID: 9735
  Gene Symbol: MROH7
  Gene Name: maestro heat-like repeat family member 7
  ENSP ID: ENSP00000402209
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHEPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVQWSRDVEAADTV

SEQ ID NO: 48102 - protein, 627 aa, Homo sapiens; identical to SEQ ID NO: 48097
  Payload ID: 9735
  Gene Symbol: MROH7
  Gene Name: maestro heat-like repeat family member 7
  Uniprot ID: Q68CQ1
  ENSP ID: ENSP00000404780

SEQ ID NO: 48103 - protein, 1069 aa, Homo sapiens
  Payload ID: 9736
  Gene Symbol: MROH8
  Gene Name: maestro heat-like repeat family member 8
  ENSP ID: ENSP00000339971
  MOD_RES (1)..(1): Any amino acid
XVAGTPTSSQPSFGPSIRERPSQSLCPCPCPAGEGDPAWPALERRLVTSRGRQPSPQSHAQLLTRRRHSSEQVPPESEPRADFRSGKWLQEPATGDARDSRQALRARMSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKHLVPWLQSVKDHERERATASMAQVLKCLSKHLNLKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAATDALYEVFLGNRLRAATFRLFPQLLMTLLIQIHHSIGLTMSDVDIPSGLYTEQEVPSEVTPLCFAMQATKTLLLRTCCLQEFNIMEKNKGWALLGGKDGHLQGLFLLANALLERNQLLAQKVMYLLVPLLNRGNDKHKLTSAGFFVELLRSPVAKRLPSIYSVARFKDWLQDGNHLFRILGLRGLYNLVGHQEMREDIKSLLPYIVDSLRETDEKIVLSAIQILLQLVRTMDFTTLAAMMRTLFSLFGDVRSDVHRFSVTLFGAAIKSVKNPDKKSIENQVLDSLVPLLLYSQDENDAVAEESRQVLTICAQFLKWKLPQEVYSKDPWHIKPTEAGTICRFFEKKCKGKINILEQTLMYSKNPKLPIRRSAVLFVGLLSKYMDHNELRRMGTDWIEDDLRDLLCDPEPSLCIIASQTLLLVQMARAEPKPKQRVNWLQKLMGRSSA

SEQ ID NO: 48104 - protein, 629 aa, Homo sapiens
  Payload ID: 9736
  Gene Symbol: MROH8
  Gene Name: maestro heat-like repeat family member 8
  ENSP ID: ENSP00000383290
  MOD_RES (1)..(1): Any amino acid
XQPRQVAGTPTSSQPSFGPSIRERPSQSLCPCPCPAGEGDPAWPALERRLVTSRGRQPSPQSHAQLLTRRRHSSEQVPPESEPRADFRSGKWLQEPATGDARDSRQALRARMSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKHLVPWLQSVKDHERERATASMAQVLKCLSKHLNLKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAVSP

SEQ ID NO: 48105 - protein, 946 aa, Homo sapiens
  Payload ID: 9736
  Gene Symbol: MROH8
  Gene Name: maestro heat-like repeat family member 8
  ENSP ID: ENSP00000383291
MPLSRRGRGSRLAGSRAATSNLPRATALSPKHAQLLTRRRHSSEQVPPESEPRADFRSGKWLQEPATGDARDSRQALRARMSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKHLVPWLQSVKDHERERATASMAQVLKCLSKHLNLKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAATDALYEVFLGNRLRAATFRLFPQLLMTLLIQIHHSIGLTMSDVDIPSGLYTEQEVPSEVTPLCFAMQATKTLLLRTCCLQEFNIMEKNKGWALLGGKDGHLQGLFLLANALLERNQLLAQKVMYLLVPLLNRGNDKHKLTSAGFFVELLRSPVAKRLPSIYSVARFKDWLQDGNHLFRILGLRGLYNLVGHQEMREDIKSLLPYIVDSLRETDEKIVLSAIQILLQLVRTMDFTTLAAMMRTLFSLFGDVRSDVHRFSVTLFGAAIKSVKNPDKKSIENQVLDSLVPLLLYSQDENDAVAEESRQVLTICAQFLKWKLPQEVYSKDPWHIKPTEAGTICRFFGKKVQGEN

SEQ ID NO: 48106 - protein, 34 aa, Homo sapiens
  Payload ID: 9736
  Gene Symbol: MROH8
  Gene Name: maestro heat-like repeat family member 8
  ENSP ID: ENSP00000389695
MRQEVFVTIADLSYQDVHLLLGSEDRAELFSLTI

SEQ ID NO: 48107 - protein, 24 aa, Homo sapiens
  Payload ID: 9736
  Gene Symbol: MROH8
  Gene Name: maestro heat-like repeat family member 8
  ENSP ID: ENSP00000400468
MRQEVFVTIADLSYQDVHLLLGSE

SEQ ID NO: 48108 - protein, 600 aa, Homo sapiens
  Payload ID: 9736
  Gene Symbol: MROH8
  Gene Name: maestro heat-like repeat family member 8
  Uniprot ID: Q9H579
  ENSP ID: ENSP00000413544
  MOD_RES (1)..(1): Any amino acid
XHPSPRHQPRQVAGTPTSSQPSFGPSIRERPSQSLCPCPCPAGEGDPAWPALERRLVTSRGRQPSPQSHAQLLTRRRHSSEQVPPESEPRADFRSGKWLQEPATGDARDSRQALRARMSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAVSP

SEQ ID NO: 48109 - protein, 670 aa, Homo sapiens
  Payload ID: 9736
  Gene Symbol: MROH8
  Gene Name: maestro heat-like repeat family member 8
  ENSP ID: ENSP00000415930
  MOD_RES (1)..(1): Any amino acid
XCNTECLYRQTFQAFSEMLQSLVVKDPHLENLDTIIKLPLRFQRLGHLVALMALLCGDPQEKVAEEAAEGIHSLLHITLRLKYITHDKKDQQNLKRALTKCREFLELHSSAAKCFYNCPFRIAQVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAATDALYEVFLGNRLRAATFRLFPQLLMTLLIQIHHSIGLTMSDVDIPSGLYTEQEVPSEVTPLCFAMQATKTLLLRTCCLQEFNIMEKNKGWALLGGKDGHLQGLFLLANALLERNQLLAQKVMYLLVPLLNRGNDKHKLTSAGFFVELLRSPVAKRLPSIYSVARFKDWLQDGNHLFRILGLRGLYNLVGHQEMREDIKSLLPYIVDSLRETDEKIVLSAIQILLQLVRTMDFTTLAAMMRTLFSLFGDVRSDVHRFSVTLFGAAIKSVKNPDKKSIENQVLDSLVPLLLYSQDENDAVAEESRQVLTICAQFLKWKLPQEVYSKDPWHIKPTEAGTICRFFEKKCKGKINILEQTLMYSKNPKLPIRRSAVLFVGLLSKYMDHNELRRMGTDWIEDDLRDLLCDPEPSLCIIASQTLLLVQMARAEPKPKQRVNWLQKLMGRSSA

SEQ ID NO: 48110 - protein, 573 aa, Homo sapiens
  Payload ID: 9737
  Gene Symbol: MROH9
  Gene Name: maestro heat-like repeat family member 9
  Uniprot ID: Q5TGP6
  ENSP ID: ENSP00000356732
MLTRNPKTKSSLQILQDSVKWHHMAHKVNSLLDAYSGLLSNESMILAVNSSFVDPLLQFESQLKIIESSFGMLVVMPSLDKVKEMGSSYEYIEDMENLYHNILNIYENILTSLVSKDLYKLQILKEMLVWMSKDSSYLQERIMVIINKVLRFTVTKVRKYISVDAPCLGLLAAELSLLCSHEDPSIVKQASLGMCHLLYIARCQNDIGTNKPTNGKSHSLQFPSSDVEFLPKEFQQDESKIAQRVGQTLLPPLLTDFVQSLLMKLSSPDDKIASDAASILIFTLEFHAEKVTMVSKIVDAIYRQLCDNNCMKDVMLQVITLLTCTSPKKVIFQLMDYPVPADDTLIQMWKAACSQASVAPHVLKTILLILKGKPGEMEDTVTEGKRFSLDITNLMPLAACQALCTFLPLGSYRKAVAQYFPQLLTTLMFQVFYNSELKPILKDRALYAQDALRVLLNCSGLQQVDITLMKENFWDQLSEDLCYYHGVCFIAKTLSEYNFPQFPETLSYLYKLSVEGPRRSEDTVIVLIFLTEVSFVDCEQLCSHFLFLPKFKSKFQFLVSLPLNVGSYQDLRS

SEQ ID NO: 48111 - protein, 861 aa, Homo sapiens
  Payload ID: 9737
  Gene Symbol: MROH9
  Gene Name: maestro heat-like repeat family member 9
  Uniprot ID: Q5TGP6
  ENSP ID: ENSP00000356733
MLTRNPKTKSSLQILQDSVKWHHMAHKVNSLLDAYSGLLSNESMILAVNSSFVDPLLQFESQLKIIESSFGMLVVMPSLDKVKEMGSSYEYIEDMENLYHNILNIYENILTSLVSKDLYKLQILKEMLVWMSKDSSYLQERIMVIINKVLRFTVTKVRKYISVDAPCLGLLAAELSLLCSHEDPSIVKQASLGMCHLLYIARCQNDIGTNKPTNGKSHSLQFPSSDVEFLPKEFQQDESKIAQRVGQTLLPPLLTDFVQSLLMKLSSPDDKIASDAASILIFTLEFHAEKVTMVSKIVDAIYRQLCDNNCMKDVMLQVITLLTCTSPKKVIFQLMDYPVPADDTLIQMWKAACSQASVAPHVLKTILLILKGKPGEMEDTVTEGKRFSLDITNLMPLAACQALCTFLPLGSYRKAVAQYFPQLLTTLMFQVFYNSELKPILKDRALYAQDALRVLLNCSGLQQVDITLMKENFWDQLSEDLCYYHGVCFIAKTLSEYNFPQFPETLSYLYKLSVEGPRRSEDTVIVLIFLTELLNNFFKDPLPEEFLVLFINWINDSNPVVSRLILHRIVHMSPIINKTENVSSILIAILDAFLSKDDNVVLQALLTLRRLLNELDKVTYSLGTRIGSSYCTLMDHINGGIRSMAIRHFGQLVRDMRQYTWMVNDVVLEGLVPLILFLEDDDKRVAEACKYTLKICTSQLKWSTSRLLKDENYSFEMVVLNICNNLIISHRNYITDLTSDTLRFLWSPRTYLKRASVILIGYLAKSGGHLLLRDEIEVMLDVIERLLRDEDPMIKQLAEITYDIFKKKAHKLTSAPLKQNFQKLLKLFYIKKLKPLYNYNSPNGQIDSPTDSKDVKNDKAL

SEQ ID NO: 48112 - protein, 187 aa, Homo sapiens
  Payload ID: 9737
  Gene Symbol: MROH9
  Gene Name: maestro heat-like repeat family member 9
  ENSP ID: ENSP00000403697
  MOD_RES (1)..(1): Any amino acid
XMPLAACQALCTFLPLGSYRKAVAQYFPQLLTTLMFQVFYNSELKPILKDRALYAQDALRVLLNCSGLQQVDITLMKENFWDQLSEDLCYYHGVCFIAKTLSEYNFPQFPETLSYLYKLSVEGPRRSEDTVIVLIFLTELLNNFFKDPLPEEFLVLFINWINDSNPVVSRLILHRIVHMSPIINKVD

SEQ ID NO: 48113 - protein, 256 aa, Homo sapiens
  Payload ID: 9738
  Gene Symbol: MAF1
  Gene Name: MAF1 homolog, negative regulator of RNA polymerase III
  Uniprot ID: Q9H063
  ENSP ID: ENSP00000318604
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYSYNPDLDSDPFGEDGSLWSFNYFFYNKRLKRIVFFSCRSISGSTYTPSEAGNELDMELGEEEVEEESRSGGSGAEETSTMEEDRVPVICI

SEQ ID NO: 48114 - protein, 70 aa, Homo sapiens
  Payload ID: 9738
  Gene Symbol: MAF1
  Gene Name: MAF1 homolog, negative regulator of RNA polymerase III
  ENSP ID: ENSP00000431907
MKLLENSSFEAINSQLTVETGDAHIIGRIESYSCKMAGDDKHMFKQFCQEGQPHVLEALSPPQTSGLSPS

SEQ ID NO: 48115 - protein, 286 aa, Homo sapiens
  Payload ID: 9738
  Gene Symbol: MAF1
  Gene Name: MAF1 homolog, negative regulator of RNA polymerase III
  ENSP ID: ENSP00000433979
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYRWAGIPADGLQASRFVGHLAPHTTCHPILPSYNPDLDSDPFGEDGSLWSFNYFFYNKRLKRIVFFSCRSISGSTYTPSEAGNELDMELGEEEVEEESRSGGSGAEETSTMEEDRVPVICI

SEQ ID NO: 48116 - protein, 252 aa, Homo sapiens
  Payload ID: 9738
  Gene Symbol: MAF1
  Gene Name: MAF1 homolog, negative regulator of RNA polymerase III
  ENSP ID: ENSP00000436030
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYRWAGIPADGLQASRFVGHLAPHTTCHPILPSYNPDLDSDPFGEDGSLWSFNYFFYNKRLKRIVFFSCRSISGSTYTPSEAGNELDM

SEQ ID NO: 48117 - protein, 164 aa, Homo sapiens
  Payload ID: 9738
  Gene Symbol: MAF1
  Gene Name: MAF1 homolog, negative regulator of RNA polymerase III
  ENSP ID: ENSP00000436639
LWSFNYFFYNKRLKRIVFFSCRSISGSTYTPSEAGNELDMELGEEEVEEESRSGGSGAEETSTMEEDRCVMGAMTRVLEAWSGYNRVGASSTWSKWWLLKAHCVPTSAQGPSDLYLMRRSRGPSFIQLQPMPGPVHLRGPWGLPSCWPDPGAATVLALPKAIPA

SEQ ID NO: 48118 - protein, 256 aa, Homo sapiens; identical to SEQ ID NO: 48113
  Payload ID: 9738
  Gene Symbol: MAF1
  Gene Name: MAF1 homolog, negative regulator of RNA polymerase III
  Uniprot ID: Q9H063
  ENSP ID: ENSP00000436720

SEQ ID NO: 48119 - protein, 124 aa, Homo sapiens
  Payload ID: 9739
  Gene Symbol:
  Gene Name: MaFF-interacting protein  [Source:UniProtKB/Swiss-Prot
  Acc:Q8WZ33]
  Uniprot ID: Q8WZ33
  ENSP ID: ENSP00000483280
MLCPRAAFLVGSFHGVFPGPPASSHWEFWVPSTPVGAYFCPPQPQLTPPNTPKLVSEVEELYKSITALREKLLQAEQSLRNLKDIHMSLEKDVTAMTNSVFIDRQKCMAHRTCYPTILQLAGYQ

SEQ ID NO: 48120 - protein, 143 aa, Homo sapiens
  Payload ID: 9740
  Gene Symbol: MAGIX
  Gene Name: MAGI family member, X-linked
  ENSP ID: ENSP00000400147
MSPNSPLHCFYLPAVSVLDSADIEVTDSRLPHATIVDHRPQVGDLVLHINGESTQGLTHAQAVERIRAGGPQLHLVIRRPLETHPGKPRGVGEPRKGVDRSPDPGGPEVTGSRSSSTSLVQHPPSRTTLKKTRGSPEPSPEAA

SEQ ID NO: 48121 - protein, 334 aa, Homo sapiens
  Payload ID: 9740
  Gene Symbol: MAGIX
  Gene Name: MAGI family member, X-linked
  ENSP ID: ENSP00000471299
MEPRTGDAADPRGSRGGRGPSPLAGPSARQLLARLDARPLAARAAVDVAALVRRAGATLRLRRKEAVSVLDSADIEVTDSRLPHATIVDHRPQHRWLETCNAPPQLIQGKARSAPKPSQASGHFSVELVRGYAGFGLTLGGGRDVAGDTPLAVRGLLKDGPAQRCGRLEVGDLVLHINGESTQGLTHAQAVERIRAGGPQLHLVIRRPLETHPGKPRGVGEPRKGVVPSWPDRSPDPGGPEVTGSRSSSTSLVQHPPSRTTLKKTRGSPEPSPEAAADGPTVSPPERRAEDPNDQIPGSPGPWLVPSEERLSRALGVRGAAQLAQEMAAGRRRH

SEQ ID NO: 48122 - protein, 258 aa, Homo sapiens
  Payload ID: 9740
  Gene Symbol: MAGIX
  Gene Name: MAGI family member, X-linked
  ENSP ID: ENSP00000479023
MEPRTGDAADPRGSRGGRGPSPLAGPSARQLLARLDARPLAARAAVDVAALVRRAGATLRLRRKEAVSVLDSADIEVTDSRLPHATIVDHRPQVGDLVLHINGESTQGLTHAQAVERIRAGGPQLHLVIRRPLETHPGKPRGVGEPRKGVVPSWPDRSPDPGGPEVTGSRSSSTSLVQHPPSRTTLKKTRGSPEPSPEAAADGPTVSPPERRAEDPNDQIPGSPGPWLVPSEERLSRALGVRGAAQLAQEMAAGRRRH

SEQ ID NO: 48123 - protein, 40 aa, Homo sapiens
  Payload ID: 9740
  Gene Symbol: MAGIX
  Gene Name: MAGI family member, X-linked
  ENSP ID: ENSP00000479878
MPLLWITGPRVRHVVLRSHPRPLVISLWSWFAVTQALASP

SEQ ID NO: 48124 - protein, 275 aa, Homo sapiens
  Payload ID: 9740
  Gene Symbol: MAGIX
  Gene Name: MAGI family member, X-linked
  ENSP ID: ENSP00000481198
MPLLWITGPRYHLILLSEASCLRANYVHLCPLFQHRWLETCNAPPQLIQGKARSAPKPSQASGHFSVELVRGYAGFGLTLGGGRDVAGDTPLAVRGLLKDGPAQRCGRLEVGDLVLHINGESTQGLTHAQAVERIRAGGPQLHLVIRRPLETHPGKPRGVGEPRKGVVPSWPDRSPDPGGPEVTGSRSSSTSLVQHPPSRTTLKKTRGSPEPSPEAAADGPTVSPPERRAEDPNDQIPGSPGPWLVPSEERLSRALGVRGAAQLAQEMAAGRRRH

SEQ ID NO: 48125 - protein, 262 aa, Homo sapiens
  Payload ID: 9740
  Gene Symbol: MAGIX
  Gene Name: MAGI family member, X-linked
  ENSP ID: ENSP00000484294
MSPNSPLHCFYLPAVSVLDSADIEVTDSRLPHATIVDHRPQGKARSAPKPSQASGHFSVELVRGYAGFGLTLGGGRDVAGDTPLAVRGLLKDGPAQRCGRLEVGDLVLHINGESTQGLTHAQAVERIRAGGPQLHLVIRRPLETHPGKPRGVGEPRKGVDRSPDPGGPEVTGSRSSSTSLVQHPPSRTTLKKTRGSPEPSPEAAADGPTVSPPERRAEDPNDQIPGSPGPWLVPSEERLSRALGVRGAAQLAQEMAAGRRRH

SEQ ID NO: 48126 - protein, 253 aa, Homo sapiens
  Payload ID: 9740
  Gene Symbol: MAGIX
  Gene Name: MAGI family member, X-linked
  ENSP ID: ENSP00000484729
MEPRTGDAADPRGSRGGRGPSPLAGPSARQLLARLDARPLAARAAVDVAALVRRAGATLRLRRKEAVSVLDSADIEVTDSRLPHATIVDHRPQVGDLVLHINGESTQGLTHAQAVERIRAGGPQLHLVIRRPLETHPGKPRGVGEPRKGVDRSPDPGGPEVTGSRSSSTSLVQHPPSRTTLKKTRGSPEPSPEAAADGPTVSPPERRAEDPNDQIPGSPGPWLVPSEERLSRALGVRGAAQLAQEMAAGRRRH

SEQ ID NO: 48127 - protein, 367 aa, Homo sapiens
  Payload ID: 9741
  Gene Symbol: MAGT1
  Gene Name: magnesium transporter 1
  ENSP ID: ENSP00000354649
MRKGKGPICLFSRPTLRPSRSKVSLIEGRGANMAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 48128 - protein, 134 aa, Homo sapiens
  Payload ID: 9741
  Gene Symbol: MAGT1
  Gene Name: magnesium transporter 1
  Uniprot ID: Q9H0U3
  ENSP ID: ENSP00000362433
MAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMFQVF

SEQ ID NO: 48129 - protein, 367 aa, Homo sapiens; identical to SEQ ID NO: 48127
  Payload ID: 9741
  Gene Symbol: MAGT1
  Gene Name: magnesium transporter 1
  ENSP ID: ENSP00000478379

SEQ ID NO: 48130 - protein, 335 aa, Homo sapiens
  Payload ID: 9741
  Gene Symbol: MAGT1
  Gene Name: magnesium transporter 1
  Uniprot ID: Q9H0U3
  ENSP ID: ENSP00000480732
MAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 48131 - protein, 176 aa, Homo sapiens
  Payload ID: 9742
  Gene Symbol: MDP1
  Gene Name: magnesium-dependent phosphatase 1
  Uniprot ID: Q86V88
  ENSP ID: ENSP00000288087
MARLPKLAVFDLDYTLWPFWVDTHVDPPFHKSSDGTVRDRRGQDVRLYPEVPEVLKRLQSLGVPGAAASRTSEIEGANQLLELFDLFRYFVHREIYPGSKITHFERLQQKTGIPFSQMIFFDDERRNIVDVSKLGVTCIHIQNGMNLQTLSQGLETFAKAQTGPLRSSLEESPFEA

SEQ ID NO: 48132 - protein, 122 aa, Homo sapiens
  Payload ID: 9742
  Gene Symbol: MDP1
  Gene Name: magnesium-dependent phosphatase 1
  Uniprot ID: Q86V88
  ENSP ID: ENSP00000380045
MARLPKLAVFDLDYTLWPFWVDTHVDPPFHKSSDGTVRDRRGQDVRLYPEVPEVLKRLQSLGVPGAAASRTSEIEGANQLLELFDLFRCYLHSHPEWNESSNSKSRVRDICEGPNWAFEVQP

SEQ ID NO: 48133 - protein, 148 aa, Homo sapiens
  Payload ID: 9743
  Gene Symbol: MAGOHB
  Gene Name: mago homolog B, exon junction complex core component
  Uniprot ID: Q96A72
  ENSP ID: ENSP00000319240
MAVASDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKIGSLIDVNQSKDPEGLRVFYYLVQDLKCLVFSLIGLHFKIKPI

SEQ ID NO: 48134 - protein, 102 aa, Homo sapiens
  Payload ID: 9743
  Gene Symbol: MAGOHB
  Gene Name: mago homolog B, exon junction complex core component
  ENSP ID: ENSP00000437462
MIRKEAYVHKSVMEELKRIIDDSEITKEDDALWPPPDRVGRQELEIVIGDEHISFTTSKIGSLIDVNQSKDPEGLRVFYYLVQDLKCLVFSLIGLHFKIKPI

SEQ ID NO: 48135 - protein, 90 aa, Homo sapiens
  Payload ID: 9743
  Gene Symbol: MAGOHB
  Gene Name: mago homolog B, exon junction complex core component
  ENSP ID: ENSP00000437512
MAVASDFYLRYYVGHKGKFGHEFLEFEFRPDGKLRYANNSNYKNDVMIRKEAYVHKSVMEELKRIIDDSEITKEDDALWPPPDRVGRQNK

SEQ ID NO: 48136 - protein, 81 aa, Homo sapiens
  Payload ID: 9743
  Gene Symbol: MAGOHB
  Gene Name: mago homolog B, exon junction complex core component
  ENSP ID: ENSP00000437548
MAVASDFYLRYYVGHKGKFGHEFLEFEFRPDGRMKSTKQEGRGKVPQEGVRKIFLEDGTLEMSLEMRDLAFERKKQTSRAV

SEQ ID NO: 48137 - protein, 44 aa, Homo sapiens
  Payload ID: 9743
  Gene Symbol: MAGOHB
  Gene Name: mago homolog B, exon junction complex core component
  ENSP ID: ENSP00000439091
MIRKEAYVHKSVMEELKRIIDDSEITKEDDALWPPPDRVGRQNK

SEQ ID NO: 48138 - protein, 81 aa, Homo sapiens; identical to SEQ ID NO: 48136
  Payload ID: 9743
  Gene Symbol: MAGOHB
  Gene Name: mago homolog B, exon junction complex core component
  ENSP ID: ENSP00000439698

SEQ ID NO: 48139 - protein, 81 aa, Homo sapiens; identical to SEQ ID NO: 48136
  Payload ID: 9743
  Gene Symbol: MAGOHB
  Gene Name: mago homolog B, exon junction complex core component
  ENSP ID: ENSP00000442440

SEQ ID NO: 48140 - protein, 81 aa, Homo sapiens; identical to SEQ ID NO: 48136
  Payload ID: 9743
  Gene Symbol: MAGOHB
  Gene Name: mago homolog B, exon junction complex core component
  ENSP ID: ENSP00000485778

SEQ ID NO: 48141 - protein, 109 aa, Homo sapiens
  Payload ID: 9744
  Gene Symbol: MAGOH
  Gene Name: mago homolog, exon junction complex core component
  Uniprot ID: P61326
  ENSP ID: ENSP00000360521
MESDFYLRYYVGHKGKFGHEFLEFEFRPDGKLRYANNSNYKNDVMIRKEELEIVIGDEHISFTTSKIGSLIDVNQSKDPEGLRVFYYLVQDLKCLVFSLIGLHFKIKPI

SEQ ID NO: 48142 - protein, 146 aa, Homo sapiens
  Payload ID: 9744
  Gene Symbol: MAGOH
  Gene Name: mago homolog, exon junction complex core component
  Uniprot ID: P61326
  ENSP ID: ENSP00000360525
MESDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKIGSLIDVNQSKDPEGLRVFYYLVQDLKCLVFSLIGLHFKIKPI

SEQ ID NO: 48143 - protein, 576 aa, Homo sapiens
  Payload ID: 9745
  Gene Symbol: MGRN1
  Gene Name: mahogunin ring finger 1, E3 ubiquitin protein ligase
  Uniprot ID: O60291
  ENSP ID: ENSP00000262370
MGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPGRPTSMETAHGLATTSPTWPPLGGPSPDPSAAELTPL

SEQ ID NO: 48144 - protein, 552 aa, Homo sapiens
  Payload ID: 9745
  Gene Symbol: MGRN1
  Gene Name: mahogunin ring finger 1, E3 ubiquitin protein ligase
  Uniprot ID: O60291
  ENSP ID: ENSP00000382487
MGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPALGPDSCSVGIDE

SEQ ID NO: 48145 - protein, 530 aa, Homo sapiens
  Payload ID: 9745
  Gene Symbol: MGRN1
  Gene Name: mahogunin ring finger 1, E3 ubiquitin protein ligase
  Uniprot ID: O60291
  ENSP ID: ENSP00000393311
MGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPALGPDSCSVGIDE

SEQ ID NO: 48146 - protein, 320 aa, Homo sapiens
  Payload ID: 9745
  Gene Symbol: MGRN1
  Gene Name: mahogunin ring finger 1, E3 ubiquitin protein ligase
  ENSP ID: ENSP00000443810
MGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLQL

SEQ ID NO: 48147 - protein, 332 aa, Homo sapiens
  Payload ID: 9745
  Gene Symbol: MGRN1
  Gene Name: mahogunin ring finger 1, E3 ubiquitin protein ligase
  ENSP ID: ENSP00000464811
  MOD_RES (1)..(1): Any amino acid
XFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDAVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPAS

SEQ ID NO: 48148 - protein, 166 aa, Homo sapiens
  Payload ID: 9745
  Gene Symbol: MGRN1
  Gene Name: mahogunin ring finger 1, E3 ubiquitin protein ligase
  ENSP ID: ENSP00000465249
EKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQHYLLQEIYGIENKNNQETKPSDDENSDNSNECVVCLSD

SEQ ID NO: 48149 - protein, 530 aa, Homo sapiens; identical to SEQ ID NO: 48145
  Payload ID: 9745
  Gene Symbol: MGRN1
  Gene Name: mahogunin ring finger 1, E3 ubiquitin protein ligase
  Uniprot ID: O60291
  ENSP ID: ENSP00000465860

SEQ ID NO: 48150 - protein, 594 aa, Homo sapiens
  Payload ID: 9745
  Gene Symbol: MGRN1
  Gene Name: mahogunin ring finger 1, E3 ubiquitin protein ligase
  ENSP ID: ENSP00000467414
MGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVDRVSYLLQEIYGIENKNNQETKISWKVSQARFIMASGPRTTGAAPRGGSGAPGRASPQPREPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPGRPTSMETAHGLATTS

SEQ ID NO: 48151 - protein, 149 aa, Homo sapiens
  Payload ID: 9745
  Gene Symbol: MGRN1
  Gene Name: mahogunin ring finger 1, E3 ubiquitin protein ligase
  ENSP ID: ENSP00000468171
MGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDE

SEQ ID NO: 48152 - protein, 554 aa, Homo sapiens
  Payload ID: 9745
  Gene Symbol: MGRN1
  Gene Name: mahogunin ring finger 1, E3 ubiquitin protein ligase
  Uniprot ID: O60291
  ENSP ID: ENSP00000468819
MGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPGRPTSMETAHGLATTSPTWPPLGGPSPDPSAAELTPL

SEQ ID NO: 48153 - protein, 465 aa, Homo sapiens
  Payload ID: 9746
  Gene Symbol: MFSD1
  Gene Name: major facilitator superfamily domain containing 1
  Uniprot ID: Q9H3U5
  ENSP ID: ENSP00000264266
MEEEDEEARALLAGGPDEADRGAPAAPGALPALCDPSRLAHRLLVLLLMCFLGFGSYFCYDNPAALQTQVKRDMQVNTTKFMLLYAWYSWPNVVLCFFGGFLIDRVFGIRWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGITCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 48154 - protein, 475 aa, Homo sapiens
  Payload ID: 9746
  Gene Symbol: MFSD1
  Gene Name: major facilitator superfamily domain containing 1
  Uniprot ID: Q9H3U5
  ENSP ID: ENSP00000376560
MGVALRDLPGRHVSSRSHVTAVLTVFHGRCFLPGFGVVTTFPSPSPAGAMEEEDEEARALLAGGPDEADRGAPAAPGALPALCDPSRLAHRLLVLLLMCFLGFAIFAMIILLPFRLKLNEWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGITCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 48155 - protein, 514 aa, Homo sapiens
  Payload ID: 9746
  Gene Symbol: MFSD1
  Gene Name: major facilitator superfamily domain containing 1
  Uniprot ID: Q9H3U5
  ENSP ID: ENSP00000403117
MGVALRDLPGRHVSSRSHVTAVLTVFHGRCFLPGFGVVTTFPSPSPAGAMEEEDEEARALLAGGPDEADRGAPAAPGALPALCDPSRLAHRLLVLLLMCFLGFGSYFCYDNPAALQTQVKRDMQVNTTKFMLLYAWYSWPNVVLCFFGGFLIDRVFGIRWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGITCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 48156 - protein, 193 aa, Homo sapiens
  Payload ID: 9746
  Gene Symbol: MFSD1
  Gene Name: major facilitator superfamily domain containing 1
  ENSP ID: ENSP00000417163
GKELNLVFGLQLSMARIGSTVNMNLMGWLYSKIEALLGSAGHTTLGITLMIGGITCILSLICALALAYLDQRAERILHKEQGKTGEVIKLTDVKDFSLPLWLIFIICVCYYVAVFPFIGLGNVVYVISAPMSPVFGLLVDKTGKNIIWVLCAVAATLVSHMMLAFTMWNPWIAMCLLGLSYSLLACALWPMVA

SEQ ID NO: 48157 - protein, 116 aa, Homo sapiens
  Payload ID: 9746
  Gene Symbol: MFSD1
  Gene Name: major facilitator superfamily domain containing 1
  ENSP ID: ENSP00000417414
MDAGKLARHPTDTGSERAVPALAEIRPWWAPPLRPQGEGSYFCYDNPAALQTQVKRDMQVNTTKFMLLYAWYSWPNVVLCFFGGFLIDRVFGIRWGTIIFSCFVCIGQVVFALGGI

SEQ ID NO: 48158 - protein, 78 aa, Homo sapiens
  Payload ID: 9746
  Gene Symbol: MFSD1
  Gene Name: major facilitator superfamily domain containing 1
  Uniprot ID: Q9H3U5
  ENSP ID: ENSP00000417950
MEEEDEEARALLAGGPDEADRGAPAAPGALPALCDPSRLAHRLLVLLLMCFLGFGSYFCYDNPAALQTQVKRMGHNHF

SEQ ID NO: 48159 - protein, 36 aa, Homo sapiens
  Payload ID: 9746
  Gene Symbol: MFSD1
  Gene Name: major facilitator superfamily domain containing 1
  ENSP ID: ENSP00000418055
MQVNTTKFMLLYAWYSWPNVVLCFFGGFLIDRVFGI

SEQ ID NO: 48160 - protein, 128 aa, Homo sapiens
  Payload ID: 9746
  Gene Symbol: MFSD1
  Gene Name: major facilitator superfamily domain containing 1
  ENSP ID: ENSP00000418503
MLLVTPRPERGGRGTELGEFCGTPLLFSKSQGLATRPRGDRYEGSYFCYDNPAALQTQVKRDMQVNTTKFMLLYAWYSWPNVVLCFFGGFLIDRVFGIRWGTIIFSCFVCIGQVVFALGGIFNAFWLM

SEQ ID NO: 48161 - protein, 78 aa, Homo sapiens
  Payload ID: 9746
  Gene Symbol: MFSD1
  Gene Name: major facilitator superfamily domain containing 1
  ENSP ID: ENSP00000419281
MEEEDEEARALLAGGPDEADRGAPAAPGALPALCDPSRLAHRLLVLLLMCFLGFGSYFCYDNPAALQTQVKRFYFLFI

SEQ ID NO: 48162 - protein, 78 aa, Homo sapiens; identical to SEQ ID NO: 48158
  Payload ID: 9746
  Gene Symbol: MFSD1
  Gene Name: major facilitator superfamily domain containing 1
  Uniprot ID: Q9H3U5
  ENSP ID: ENSP00000419467

SEQ ID NO: 48163 - protein, 161 aa, Homo sapiens
  Payload ID: 9746
  Gene Symbol: MFSD1
  Gene Name: major facilitator superfamily domain containing 1
  ENSP ID: ENSP00000419708
MLLVTPRPERGGRGTELGEFCGTPLLFSSYFCYDNPAALQTQVKRDMQVNTTKFMLLYAWYSWPNVVLCFFGGFLIDRVFGIRWGTIIFSCFVCIGQVVFALGGIFNAFWLMEFGRFVFGIGGESLAVAQNTYAVSWFKGKELNLVFGLQLSMARIGSTVN

SEQ ID NO: 48164 - protein, 85 aa, Homo sapiens
  Payload ID: 9746
  Gene Symbol: MFSD1
  Gene Name: major facilitator superfamily domain containing 1
  ENSP ID: ENSP00000420699
MDAGKLARHPTDTGSERAVPALAEIRPWWAPPLRPQGEDNCETPVPGPGGMRVNNLKHLCLPGAHLLGSYFCYDNPAALQTQVKR

SEQ ID NO: 48165 - protein, 64 aa, Homo sapiens
  Payload ID: 9746
  Gene Symbol: MFSD1
  Gene Name: major facilitator superfamily domain containing 1
  ENSP ID: ENSP00000420816
EEEDEEARALLAGGPDEADRGAPAAPGALPALCDPSRLAHRLLAAIFAMIILLPFRLKLNEICK

SEQ ID NO: 48166 - protein, 514 aa, Homo sapiens; identical to SEQ ID NO: 48155
  Payload ID: 9746
  Gene Symbol: MFSD1
  Gene Name: major facilitator superfamily domain containing 1
  Uniprot ID: Q9H3U5
  ENSP ID: ENSP00000484175

SEQ ID NO: 48167 - protein, 455 aa, Homo sapiens
  Payload ID: 9747
  Gene Symbol: MFSD10
  Gene Name: major facilitator superfamily domain containing 10
  Uniprot ID: Q14728
  ENSP ID: ENSP00000332646
MGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFAAAVVVPCLSSVVAGYGSPGQKGTVMGTLRSLGALARAAGPLVAASVYWLAGAQACFTTWSGLFLLPFFLLQKLSYPAQTLKAE

SEQ ID NO: 48168 - protein, 455 aa, Homo sapiens; identical to SEQ ID NO: 48167
  Payload ID: 9747
  Gene Symbol: MFSD10
  Gene Name: major facilitator superfamily domain containing 10
  Uniprot ID: Q14728
  ENSP ID: ENSP00000347619

SEQ ID NO: 48169 - protein, 366 aa, Homo sapiens
  Payload ID: 9747
  Gene Symbol: MFSD10
  Gene Name: major facilitator superfamily domain containing 10
  ENSP ID: ENSP00000423402
MGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSRPSCCWCPPSSSSAGDVLCPCWAWGCCSTPLPPPLWCPACPPWSLAMAHQGRRARSWVHCAA

SEQ ID NO: 48170 - protein, 242 aa, Homo sapiens
  Payload ID: 9747
  Gene Symbol: MFSD10
  Gene Name: major facilitator superfamily domain containing 10
  ENSP ID: ENSP00000423509
MGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMPPTCCSSSASCQRRCPWRNGRPLSPWGSVMRLICSAPWPCCASRLSLVARTHPLETGSAACAAWA

SEQ ID NO: 48171 - protein, 356 aa, Homo sapiens
  Payload ID: 9747
  Gene Symbol: MFSD10
  Gene Name: major facilitator superfamily domain containing 10
  ENSP ID: ENSP00000425757
MGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRAHQGRRARSWVHCAA

SEQ ID NO: 48172 - protein, 480 aa, Homo sapiens
  Payload ID: 9747
  Gene Symbol: MFSD10
  Gene Name: major facilitator superfamily domain containing 10
  ENSP ID: ENSP00000426907
MGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFAAAVVVPCLSSVVAGYGSPGQKGTVMGTLRSLGALARAAGPLVAASGEGAGWCWGRLGAKHLPSPPKCQPPRGLGDATVSPQCTGWPGPRPASPRGPGSFCSPSSSCRS

SEQ ID NO: 48173 - protein, 100 aa, Homo sapiens
  Payload ID: 9747
  Gene Symbol: MFSD10
  Gene Name: major facilitator superfamily domain containing 10
  ENSP ID: ENSP00000427637
MGWGGGGGCTPRPPIHQQPPERRVVTVVFLGLLLDLLAFTLLLPLLPGLLESHGRAHDPLYGSWQGGVDWFATAIGMPVEKRYNSVLFGVSVCATHWGHL

SEQ ID NO: 48174 - protein, 449 aa, Homo sapiens
  Payload ID: 9748
  Gene Symbol: MFSD11
  Gene Name: major facilitator superfamily domain containing 11
  Uniprot ID: O43934
  ENSP ID: ENSP00000337240
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAAVLWTAQGNCLTINSDEHSIGRNSGIFWALLQSSLFFGNLYIYFAWQGKTQISESDRRTVFIALTVISLVGTVLFFLIRKPDSENVLGEDESSDDQDMEVNESAQNNLTKAVDAFKKSFKLCVTKEMLLLSITTAYTGLELTFFSGVYGTCIGATNKFGAEEKSLIGLSGIFIGIGEILGGSLFGLLSKNNRFGRNPVVLLGILVHFIAFYLIFLNMPGDAPIAPVKGTDSSAYIKSSKEVAILCSFLLGLGDSCFNTQLLSILGFLYSEDSAPAFAIFKFVQSICAAVAFFYSNYLLLHWQLLVMVIFGFFGTISFFTVEWEAAAFVARGSDYRSI

SEQ ID NO: 48175 - protein, 397 aa, Homo sapiens
  Payload ID: 9748
  Gene Symbol: MFSD11
  Gene Name: major facilitator superfamily domain containing 11
  Uniprot ID: O43934
  ENSP ID: ENSP00000348225
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAAESDRRTVFIALTVISLVGTVLFFLIRKPDSENVLGEDESSDDQDMEVNESAQNNLTKAVDAFKKSFKLCVTKEMLLLSITTAYTGLELTFFSGVYGTCIGATNKFGAEEKSLIGLSGIFIGIGEILGGSLFGLLSKNNRFGRNPVVLLGILVHFIAFYLIFLNMPGDAPIAPVKGTDSSAYIKSSKEVAILCSFLLGLGDSCFNTQLLSILGFLYSEDSAPAFAIFKFVQSICAAVAFFYSNYLLLHWQLLVMVIFGFFGTISFFTVEWEAAAFVARGSDYRSI

SEQ ID NO: 48176 - protein, 449 aa, Homo sapiens; identical to SEQ ID NO: 48174
  Payload ID: 9748
  Gene Symbol: MFSD11
  Gene Name: major facilitator superfamily domain containing 11
  Uniprot ID: O43934
  ENSP ID: ENSP00000464932

SEQ ID NO: 48177 - protein, 62 aa, Homo sapiens
  Payload ID: 9748
  Gene Symbol: MFSD11
  Gene Name: major facilitator superfamily domain containing 11
  ENSP ID: ENSP00000466223
MSPESKKLFNIIILGVAFMFMFTAFQTCGNVAQTVIRSLNRTDFHGSGYTSMAIIYGVFSAS

SEQ ID NO: 48178 - protein, 114 aa, Homo sapiens
  Payload ID: 9748
  Gene Symbol: MFSD11
  Gene Name: major facilitator superfamily domain containing 11
  ENSP ID: ENSP00000466412
MSPESKKLFNIIILGVAFMFMFTAFQTCGNVAQTVIRSLNRTDFHGSGYTSMAIIYGVFSASNLITPSVVAIVGPQLSMFASGLFYSLSRGPSTQPLFSLELLLLCFGQHKETA

SEQ ID NO: 48179 - protein, 117 aa, Homo sapiens
  Payload ID: 9748
  Gene Symbol: MFSD11
  Gene Name: major facilitator superfamily domain containing 11
  ENSP ID: ENSP00000466584
QGNCLTINSDEHSIGRNSGIFWALLQSSLFFGNLYIYFAWQGKTQISESDRRTVFIALTVISLVGTVLFFLIRKPDSENVLGEDESSDDQDMEVNEHWVFYKLKACGNPASSLPRTI

SEQ ID NO: 48180 - protein, 449 aa, Homo sapiens; identical to SEQ ID NO: 48174
  Payload ID: 9748
  Gene Symbol: MFSD11
  Gene Name: major facilitator superfamily domain containing 11
  Uniprot ID: O43934
  ENSP ID: ENSP00000466613

SEQ ID NO: 48181 - protein, 397 aa, Homo sapiens; identical to SEQ ID NO: 48175
  Payload ID: 9748
  Gene Symbol: MFSD11
  Gene Name: major facilitator superfamily domain containing 11
  Uniprot ID: O43934
  ENSP ID: ENSP00000466782

SEQ ID NO: 48182 - protein, 41 aa, Homo sapiens
  Payload ID: 9748
  Gene Symbol: MFSD11
  Gene Name: major facilitator superfamily domain containing 11
  ENSP ID: ENSP00000467375
MSPESKKLFNIIILGVAFMFMFTAFQTCGNVAVSWNLSSLL

SEQ ID NO: 48183 - protein, 41 aa, Homo sapiens; identical to SEQ ID NO: 48182
  Payload ID: 9748
  Gene Symbol: MFSD11
  Gene Name: major facilitator superfamily domain containing 11
  ENSP ID: ENSP00000467879

SEQ ID NO: 48184 - protein, 111 aa, Homo sapiens
  Payload ID: 9748
  Gene Symbol: MFSD11
  Gene Name: major facilitator superfamily domain containing 11
  ENSP ID: ENSP00000468223
MSPESKKLFNIIILGVAFMFMFTAFQTCGNVAQTVIRSLNRTDFHGSGYTSMAIIYGVFSASNLITPSVVAIVGPQLSMFASGLFYSLCFHWNCCCCALDSTRKLPDNQFG

SEQ ID NO: 48185 - protein, 449 aa, Homo sapiens; identical to SEQ ID NO: 48174
  Payload ID: 9748
  Gene Symbol: MFSD11
  Gene Name: major facilitator superfamily domain containing 11
  Uniprot ID: O43934
  ENSP ID: ENSP00000468309

SEQ ID NO: 48186 - protein, 211 aa, Homo sapiens
  Payload ID: 9748
  Gene Symbol: MFSD11
  Gene Name: major facilitator superfamily domain containing 11
  ENSP ID: ENSP00000468562
  MOD_RES (1)..(1): Any amino acid
XAYTGLELTFFSGVYGTCIGATNKFGAEEKSLIGLSGIFIGIGEILGGSLFGLLSKNNRFGRNPVVLLGILVHFIAFYLIFLNMPGDAPIAPVKGTDSSAYIKSSKEVAILCSFLLGLGDSCFNTQLLSILGFLYSEDSAPAFAIFKFVQFLWVGNLRMAELSPERLSRLQSMSLQAAVKVCSRLHWGRACFPAHSYSCCRSQFLTDCQAK

SEQ ID NO: 48187 - protein, 128 aa, Homo sapiens
  Payload ID: 9748
  Gene Symbol: MFSD11
  Gene Name: major facilitator superfamily domain containing 11
  ENSP ID: ENSP00000468616
FMFTAFQTCGNVAQTVIRSLNRTDFHGSGYTSMAIIYGVFSASNLITPSVVAIVGPQLSMFASGLFYSMYIAVFIQPFPWSFYTASVFIGIAAAVLWTAQGNCLTINSDEHSIGRNSGIFWALLQSRE

SEQ ID NO: 48188 - protein, 113 aa, Homo sapiens
  Payload ID: 9748
  Gene Symbol: MFSD11
  Gene Name: major facilitator superfamily domain containing 11
  ENSP ID: ENSP00000468758
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAA

SEQ ID NO: 48189 - protein, 449 aa, Homo sapiens; identical to SEQ ID NO: 48174
  Payload ID: 9748
  Gene Symbol: MFSD11
  Gene Name: major facilitator superfamily domain containing 11
  Uniprot ID: O43934
  ENSP ID: ENSP00000485005

SEQ ID NO: 48190 - protein, 480 aa, Homo sapiens
  Payload ID: 9749
  Gene Symbol: MFSD12
  Gene Name: major facilitator superfamily domain containing 12
  Uniprot ID: Q6NUT3
  ENSP ID: ENSP00000347583
MGPGPPAAGAAPSPRPLSLVARLSYAVGHFLNDLCASMWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRWDRDARP

SEQ ID NO: 48191 - protein, 471 aa, Homo sapiens
  Payload ID: 9749
  Gene Symbol: MFSD12
  Gene Name: major facilitator superfamily domain containing 12
  Uniprot ID: Q6NUT3
  ENSP ID: ENSP00000374046
MGPGPPAAGAAPSPRPLSLVARLSYAVGHFLNDLCASMWFTYLLLYLHSVRAYSSRGAGLLLLLGQVADGLCTPLVGYEADRAASCCARYGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRWDRDARP

SEQ ID NO: 48192 - protein, 175 aa, Homo sapiens
  Payload ID: 9749
  Gene Symbol: MFSD12
  Gene Name: major facilitator superfamily domain containing 12
  ENSP ID: ENSP00000381566
  MOD_RES (1)..(1): Any amino acid
XGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRSFLAWRRGRGEDKGPGYSWIPTVLVQPPRPTSPFLWEAPLAWRCTRKKWSGAGTKPWPREDWGTH

SEQ ID NO: 48193 - protein, 259 aa, Homo sapiens
  Payload ID: 9749
  Gene Symbol: MFSD12
  Gene Name: major facilitator superfamily domain containing 12
  ENSP ID: ENSP00000465302
LSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNNSGAFVYGSMSFLDKVANGLAVMAIQSLHPCPSELCCRACVSFYHWAMVAVTGGVGVAAALCLCSLL

SEQ ID NO: 48194 - protein, 71 aa, Homo sapiens
  Payload ID: 9749
  Gene Symbol: MFSD12
  Gene Name: major facilitator superfamily domain containing 12
  ENSP ID: ENSP00000465782
MSPRRQGLMGHRLRPAVLPLHLQPLPGLWGGHARVGCPPLLRPVHRDLPVWLGLHTDLPPQPHPGARHQRP

SEQ ID NO: 48195 - protein, 147 aa, Homo sapiens
  Payload ID: 9749
  Gene Symbol: MFSD12
  Gene Name: major facilitator superfamily domain containing 12
  ENSP ID: ENSP00000466906
MSPRRQGLMGLECSHRISAHCNLELLGSSDSPASASRAVGTTEPVPAGGGCRRRVLTAIPPGHPGEAPAACGGARRAHPPVGPCHGPAPAALEALAPGAGFLPGGHTVHDHQAHREPVPDLHGHVPHLLAPPAQEVHRDHSPGDVPQ

SEQ ID NO: 48196 - protein, 471 aa, Homo sapiens; identical to SEQ ID NO: 48191
  Payload ID: 9749
  Gene Symbol: MFSD12
  Gene Name: major facilitator superfamily domain containing 12
  Uniprot ID: Q6NUT3
  ENSP ID: ENSP00000467207

SEQ ID NO: 48197 - protein, 180 aa, Homo sapiens
  Payload ID: 9749
  Gene Symbol: MFSD12
  Gene Name: major facilitator superfamily domain containing 12
  ENSP ID: ENSP00000467635
LSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRCESWPTPPSPDTDPHSLMPFPPLPCRGP

SEQ ID NO: 48198 - protein, 53 aa, Homo sapiens
  Payload ID: 9749
  Gene Symbol: MFSD12
  Gene Name: major facilitator superfamily domain containing 12
  ENSP ID: ENSP00000468287
MSPRRQGLMGARSSAAVFTSKETFPDLPTARRSNQPPAARPRRPPRPSPPPAC

SEQ ID NO: 48199 - protein, 163 aa, Homo sapiens
  Payload ID: 9749
  Gene Symbol: MFSD12
  Gene Name: major facilitator superfamily domain containing 12
  ENSP ID: ENSP00000478456
KFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRR

SEQ ID NO: 48200 - protein, 143 aa, Homo sapiens
  Payload ID: 9749
  Gene Symbol: MFSD12
  Gene Name: major facilitator superfamily domain containing 12
  ENSP ID: ENSP00000481557
MVLADAAKMRSPRVRMAPNPVPGTLIRRGKLGRRQEGRVKTEAETGGQGVPGVAQSHHGLQEVWDRLSQPQKGPAPHRPGFQRANISVAEAPSAFAVLGDGRRHICSWPVSRSVAPTVSGHWPEGNRKSWRGRHTHEPFRNNE

SEQ ID NO: 48201 - protein, 543 aa, Homo sapiens
  Payload ID: 9750
  Gene Symbol: MFSD2A
  Gene Name: major facilitator superfamily domain containing 2A
  Uniprot ID: Q8NA29
  ENSP ID: ENSP00000361895
MAKGEGAESGSAAGLLPTSILQSTERPAQVKKEPKKKKQQLSVCNKLCYALGGAPYQVTGCALGFFLQIYLLDVAQKDEEVVFCFSSFQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 48202 - protein, 530 aa, Homo sapiens
  Payload ID: 9750
  Gene Symbol: MFSD2A
  Gene Name: major facilitator superfamily domain containing 2A
  Uniprot ID: Q8NA29
  ENSP ID: ENSP00000361898
MAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 48203 - protein, 374 aa, Homo sapiens
  Payload ID: 9750
  Gene Symbol: MFSD2A
  Gene Name: major facilitator superfamily domain containing 2A
  ENSP ID: ENSP00000391261
MVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 48204 - protein, 266 aa, Homo sapiens
  Payload ID: 9750
  Gene Symbol: MFSD2A
  Gene Name: major facilitator superfamily domain containing 2A
  ENSP ID: ENSP00000407606
MAKGEGAESGSAAGLLPTSILQSTERPAQKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQR

SEQ ID NO: 48205 - protein, 504 aa, Homo sapiens
  Payload ID: 9751
  Gene Symbol: MFSD2B
  Gene Name: major facilitator superfamily domain containing 2B
  ENSP ID: ENSP00000342501
MAAPPAPAAKGSPQPEPHAPEPGPGSAKRGREDSRAGRLSFCTKVCYGIGGVPNQIASSATAFYLQLFLLDIAQIPAAQVSLVLFGGKVSGAAADPVAGFFINRSQRTGSGRLMPWVLGCTPFIALAYFFLWFLPPFTSLRGLWYTTFYCLFQALATFFQVPYTALTMLLTPCPRERDSATAYRMTVEMAGTLMGATVHGLIVSGAHRPHRCEATATPGPVTVSPNAAHLYCIAAAVVVVTYPVCISLLCLGVKERPDPSAPASGPGLSFLAGLSLTTRHPPYLKLVISFLFISAAVQVEQSYLVLFCTHASQLHDHVQGLVLTVLVSAVLSTPLWEWVLQRFGKKTSAFGIFAMVPFAILLAAVPTAPVAYVVAFVSGVSIAVSLLLPWSMLPDVVDDFQLQHRHGPGLETIFYSSYVFFTKLSGACALGISTLSLEFSGYKAGVCKQAEEVVVTLKVLIGAVPTCMILAGLCILMVGSTPKTPSRDASSRLSLRRRTSYSLA

SEQ ID NO: 48206 - protein, 497 aa, Homo sapiens
  Payload ID: 9751
  Gene Symbol: MFSD2B
  Gene Name: major facilitator superfamily domain containing 2B
  Uniprot ID: A6NFX1
  ENSP ID: ENSP00000385527
MAAPPAPAAKGSPQPEPHAPEPGPGSAKRGREDSRAGRLSFCTKVCYGIGGVPNQIASSATAFYLQLFLLDIAQIPAAQVSLVLFGGKVSGAAADPVAGFFINRSQRTGSGRLMPWVLGCTPFIALAYFFLWFLPPFTSLRGLWYTTFYCLFQALATFFQVPYTALTMLLTPCPRERDSATAYRMTVEMAGTLMGATVHGLIVSGAHRPHRCEATATPGPVTVSPNAAHLYCIAAAVVVVTYPVCISLLCLGVKERPDPSAPASGPGLSFLAGLSLTTRHPPYLKLVISFLFISAAVQVEQSYLVLFCTHASQLHDHVQGLVLTVLVSAVLSTPLWEWVLQRFGKKTSAFGIFAMVPFAILLAAVPTAPVAYVVAFVSGVSIAVSLLLPWSMLPDVVDDFQLQHRHGPGLETIFYSSYVFFTKLSGACALGISTLSLEFSGYKAGVCKQAEEVVVTLKVLIGAVPTCMILAGLCILMVGSTPKTPSRDASSRLSLRR

SEQ ID NO: 48207 - protein, 44 aa, Homo sapiens
  Payload ID: 9751
  Gene Symbol: MFSD2B
  Gene Name: major facilitator superfamily domain containing 2B
  ENSP ID: ENSP00000390490
KVLIGAVPTCMILAGLCILMVGSTPKTPSRDASSRLSLRRVLHH

SEQ ID NO: 48208 - protein, 412 aa, Homo sapiens
  Payload ID: 9752
  Gene Symbol: MFSD3
  Gene Name: major facilitator superfamily domain containing 3
  Uniprot ID: Q96ES6
  ENSP ID: ENSP00000301327
MRGKLLPLAGLYLVQGLPYGLQSGLLPVLLRAGGLSLTRVGLAKVLYAPWLLKLAWAPLVDAQGSARAWVTRSTAGLGLVCGLLAGLPPPGAGQAGLPAAVAGLLLLLNLGAAMQDVALDALAVQLLEPAELGPGNTVQVVAYKLGAALAGGALLALLPTFSWPQLFLLLAATYWLAAALAWAAPALRRLPQQPPSEQRPHTAHLLRDVLAVPGTVWTAGFVLTYKLGEQGASSLFPLLLLDHGVSAPELGLWNGVGAVVCSIAGSSLGGTLLAKHWKLLPLLRSVLRFRLGGLACQTALVFHLDTLGASMDAGTILRGSALLSLCLQHFLGGLVTTVTFTGMMRCSQLAPRALQATHYSLLATLELLGKLLLGTLAGGLADGLGPHPCFLLLLILSAFPVLYLDLAPSTFL

SEQ ID NO: 48209 - protein, 514 aa, Homo sapiens
  Payload ID: 9753
  Gene Symbol: MFSD4
  Gene Name: major facilitator superfamily domain containing 4
  Uniprot ID: Q8N468
  ENSP ID: ENSP00000356115
MGCDGRVSGLLRRNLQPTLTYWSVFFSFGLCIAFLGPTLLDLRCQTHSSLPQISWVFFSQQLCLLLGSALGGVFKRTLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINLPVPMAVLMLLSKERLLTCCPQRRPLLLSADELALETQPPEKEDASSLPPKFQSHLGHEDLFSCCQRKNLRGAPYSFFAIHITGALVLFMTDGLTGAYSAFVYSYAVEKPLSVGHKVAGYLPSLFWGFITLGRLLSIPISSRMKPATMVFINVVGVVVTFLVLLIFSYNVVFLFVGTASLGLFLSSTFPSMLAYTEDSLQYKGCATTVLVTGAGVGEMVLQMLVGSIFQAQGSYSFLVCGVIFGCLAFTFYILLLFFHRMHPGLPSVPTQDRSIGMENSECYQR

SEQ ID NO: 48210 - protein, 459 aa, Homo sapiens
  Payload ID: 9753
  Gene Symbol: MFSD4
  Gene Name: major facilitator superfamily domain containing 4
  ENSP ID: ENSP00000440183
MEEKGEGMLPAPSPDITLPSCSLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINLPVPMAVLMLLSKERLLTCCPQRRPLLLSADELALETQPPEKEDASSLPPKFQSHLGHEDLFSCCQRKNLRGAPYSFFAIHITGALVLFMTDGLTGAYSAFVYSYAVEKPLSVGHKVAGYLPSLFWGFITLGRLLSIPISSRMKPATMVFINVVGVVVTFLVLLIFSYNVVFLFVGTASLGLFLSSTFPSMLAYTEDSLQYKGCATTVLVTGAGVGEMVLQMLVGSIFQAQGSYSFLVCGVIFGCLAFTFYILLLFFHRMHPGLPSVPTQDRSIGMENSECYQR

SEQ ID NO: 48211 - protein, 440 aa, Homo sapiens
  Payload ID: 9753
  Gene Symbol: MFSD4
  Gene Name: major facilitator superfamily domain containing 4
  ENSP ID: ENSP00000445329
MGCDGRVSGLLRRNLQPTLTYWSVFFSFGLCIAFLGPTLLDLRCQTHSSLPQISWVFFSQQLCLLLGSALGGVFKRTLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINLPVPMAVLMLLSKERLLTCCPQRRPLLLSADELALETQPPEKEDASSLPPKFQSHLGHEDLFSCCQRKNLRGAPYSFFAIHITGALVLFMTDGLTGAYSAFVYSYAVEKPLSVGHKVAGYLPSLFWGFITLGRLLSIPISSRMKPATMVFINVVGVVVTFLVLLIFSYNVVFLFVGTASLGLFLSSTFPSMLAYTEDSLQYKDIPGSGQL

SEQ ID NO: 48212 - protein, 361 aa, Homo sapiens
  Payload ID: 9753
  Gene Symbol: MFSD4
  Gene Name: major facilitator superfamily domain containing 4
  ENSP ID: ENSP00000478732
MGCDGRVSGLLRRNLQPTLTYWSVFFSFGLCIAFLGPTLLDLRCQTHSSLPQISWVFFSQQLCLLLGSALGGVFKRTLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINVGVVVTFLVLLIFSYNVVFLFVGTASLGLFLSSTFPSMLAYTEDSLQYKGCATTVLVTGAGVGEMVLQMLVGSIFQAQGSYSFLVCGVIFGCLAFTFYILLLFFHRMHPGLPSVPTQDRSIGMENSECYQR

SEQ ID NO: 48213 - protein, 126 aa, Homo sapiens
  Payload ID: 9753
  Gene Symbol: MFSD4
  Gene Name: major facilitator superfamily domain containing 4
  ENSP ID: ENSP00000480554
MEEKGEGMLPAPSPDITLPSCSLAQSLWALFTSSLAISLVFAVIPFCRDVKVLASVMALAGLAMGCIDTVANMQLVRMYQKDSAVFLQLPVPMAVLMLLSKERLLTCCPQRRPLLLSADELALETQ

SEQ ID NO: 48214 - protein, 88 aa, Homo sapiens
  Payload ID: 9753
  Gene Symbol: MFSD4
  Gene Name: major facilitator superfamily domain containing 4
  ENSP ID: ENSP00000482239
MGCDGRVSGLLRRNLQPTLTYWSVFFSFGLCIAFLGPTLLDLRCQTHSSLPQISWVFFSQQLCLLLGSALGGVFKRTCSISSWALVLC

SEQ ID NO: 48215 - protein, 121 aa, Homo sapiens
  Payload ID: 9753
  Gene Symbol: MFSD4
  Gene Name: major facilitator superfamily domain containing 4
  ENSP ID: ENSP00000483626
MALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINLP

SEQ ID NO: 48216 - protein, 450 aa, Homo sapiens
  Payload ID: 9754
  Gene Symbol: MFSD5
  Gene Name: major facilitator superfamily domain containing 5
  Uniprot ID: Q6N075
  ENSP ID: ENSP00000332624
MLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 48217 - protein, 557 aa, Homo sapiens
  Payload ID: 9754
  Gene Symbol: MFSD5
  Gene Name: major facilitator superfamily domain containing 5
  Uniprot ID: Q6N075
  ENSP ID: ENSP00000442688
MEVTAVGEEANQGDLLGFGQRCCSLGSSNPWLYRTAGIFPEHCTEEKKIGTYFRVAPQASKSQRSRCHGMAASEARPGEATAASYGRPFPTHPRRQEFRARVVRGPTMLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 48218 - protein, 412 aa, Homo sapiens
  Payload ID: 9754
  Gene Symbol: MFSD5
  Gene Name: major facilitator superfamily domain containing 5
  ENSP ID: ENSP00000449354
MEVTAVGEEANQGDLLGFGQRCCSLGSSNPWLYRTAGIFPEHCTEEKKIGTYFRVAPQASKSQRSRCHGMAASEARPGEATAASYGRPFPTHPRRQEFRARVVRGPTMLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSK

SEQ ID NO: 48219 - protein, 791 aa, Homo sapiens
  Payload ID: 9755
  Gene Symbol: MFSD6
  Gene Name: major facilitator superfamily domain containing 6
  Uniprot ID: Q6ZSS7
  ENSP ID: ENSP00000281416
MADDKVAILTDDEEEQKRKYVLADPFNGISREPEPPSNETPSSTETSAIPEEEIDWIEKHCVKINNDLLISKVFYFFFYSAYGSLYPLLPVYYKQLGMSPSQSGLLVGIRYFIEFCSAPFWGVVADRFKKGKIVLLFSLLCWVLFNLGIGFVKPATLRCVPKIRPTTHPTNASHQLTILPTNSSFTSFLTISPKMREKRNLLETRLNVSDTVTLPTAPNMNSEPTLQPQTGEITNRMMDLTLNSSTATPVSPGSVTKETTTVIVTTTKSLPSDQVMLVYDQQEVEAIFLVILVVVIIGEFFSASSVTIVDTVTLQYLGKHRDRYGLQRMWGSLGWGLAMLSVGIGIDYTHIEVLIDGKGCKPPEYRNYQIVFIVFGVLMTMALIVATQFRFRYNHFKNDDSKGKEVEIPQVERNNSTESSEETPTTTSHSQAFNFWDLIKLLCSVQYGSVLFVAWFMGFGYGFVFTFLYWHLEDLNGTTTLFGVCSVLSHVSELTAYFFSHKLIELIGHIRVLYIGLACNTARYIYISYLENAWTVLPMEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVMPRIEPRLPPKKTKHQEEQEDVNKPAWGVSSSPWVTFVYALYQIKEMMQLTRDNRASEIQPLQGTNENRENSPAGRAQPVPCETHSDPSRNQPSPDAAASQTQTSPAHPSVDPCTEESEEQQAQLAAGGH

SEQ ID NO: 48220 - protein, 791 aa, Homo sapiens; identical to SEQ ID NO: 48219
  Payload ID: 9755
  Gene Symbol: MFSD6
  Gene Name: major facilitator superfamily domain containing 6
  Uniprot ID: Q6ZSS7
  ENSP ID: ENSP00000376141

SEQ ID NO: 48221 - protein, 271 aa, Homo sapiens
  Payload ID: 9755
  Gene Symbol: MFSD6
  Gene Name: major facilitator superfamily domain containing 6
  ENSP ID: ENSP00000397276
  MOD_RES (1)..(1): Any amino acid
XTFLYWHLEDLNGTTTLFGVCSVLSHVSELTAYFFSHKLIELIGHIRVLYIGLACNTARYIYISYLENAWTVLPMEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVMPRIEPRLPPKKTKHQEEQEDVNKPAWGVSSSPWVTFVYALYQIKEMMQLTRDNRASEIQPLQLHIGKEMKGDQ

SEQ ID NO: 48222 - protein, 42 aa, Homo sapiens
  Payload ID: 9755
  Gene Symbol: MFSD6
  Gene Name: major facilitator superfamily domain containing 6
  ENSP ID: ENSP00000398737
MADDKVAILTDDEEEQKRKYVLADPFNGISREPEPPSNETPS

SEQ ID NO: 48223 - protein, 114 aa, Homo sapiens
  Payload ID: 9755
  Gene Symbol: MFSD6
  Gene Name: major facilitator superfamily domain containing 6
  ENSP ID: ENSP00000400131
MADDKVAILTDDEEEQKRKYVLADPFNGISREPEPPSNETPSSTETSAIPEEEIDWIEKHCVKINNDLLISKVFYFFFYSAYGSLYPLLPVYYKQLGMSPSQSGLLVGIRYFIE

SEQ ID NO: 48224 - protein, 156 aa, Homo sapiens
  Payload ID: 9755
  Gene Symbol: MFSD6
  Gene Name: major facilitator superfamily domain containing 6
  ENSP ID: ENSP00000403762
MADDKVAILTDDEEEQKRKYVLADPFNGISREPEPPSNETPSSTETSAIPEEEIDWIEKHCVKINNDLLISKVFYFFFYSAYGSLYPLLPVYYKQLGMSPSQSGLLVGIRYFIEFCSAPFWGVVADRFKKGKIVLLFSLLCWVLFNLGIGFVKPAT

SEQ ID NO: 48225 - protein, 91 aa, Homo sapiens
  Payload ID: 9755
  Gene Symbol: MFSD6
  Gene Name: major facilitator superfamily domain containing 6
  ENSP ID: ENSP00000404511
  MOD_RES (1)..(1): Any amino acid
XLYQIKEMMQLTRDNRASEIQPLQGTNENRENSPAGRAQPVPCETHSDPSRNQPSPDAAASQTQTSPAHPSVDPCTEESEEQQAQLAAGGH

SEQ ID NO: 48226 - protein, 179 aa, Homo sapiens
  Payload ID: 9755
  Gene Symbol: MFSD6
  Gene Name: major facilitator superfamily domain containing 6
  ENSP ID: ENSP00000406837
MEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVMPRIEPRLPPKKTKHQEEQEDVNKPAWGVSSSPWVTFVYALYQIKEMMQLTRDNRA

SEQ ID NO: 48227 - protein, 586 aa, Homo sapiens
  Payload ID: 9756
  Gene Symbol: MFSD6L
  Gene Name: major facilitator superfamily domain containing 6-like
  Uniprot ID: Q8IWD5
  ENSP ID: ENSP00000330051
MSANPRWDISRALGVAKLFHLVCGVREACVTPFLTLYLRQLGLAAPWVGTLMGTKHLIAAFWAPVCAFLAKSYRKRRALLIGSLLGSVGASLLMVLVPPVDKNRVHFPCNGSSGLTSTDALPGVTLPVNITSAQESASSHPAKRTAEVEMPGFRNPPGESDRETFRDLHVYLAPSVEGARTTSQALLHPVTSGLKDHPWEVTFEVVKTALPLLPGGKGPGNPANLSGTKGKAWAFDLSLEALRRTFILSLGSVAFWELLTAPLEQVADDSLYEFLDFVDATDRYRSLWVWRLLGMSAGVCGITALVGQLDCFLMTSGPRGVVHFYGYSVVSTLALLVSIAFPIPICQQWEPSYKRVKALSIVGGDPHLILLASTTVLVGAIVSTVQNFLFWHMKDHGSGELVMGFSVALSLLGEILLHPFKATLLRKLSRTGLVGLGLSCLAGQLLYYSFLWSWWSVLPIQILSAISNRALWWAVGASVEDLATPRMERALSALFRGHFYGSGCSLGSFVGGFVVMRFSLAVLYQACCVALLLWLALLLSIQRRLPRERKIKYSKLLSMEVSDTSDSEQGTEQDWLVKAMREEHSD

SEQ ID NO: 48228 - protein, 441 aa, Homo sapiens
  Payload ID: 9757
  Gene Symbol: MFSD7
  Gene Name: major facilitator superfamily domain containing 7
  Uniprot ID: Q6UXD7
  ENSP ID: ENSP00000307545
MAGPTEAETGLAEPRALCAQRGHRTYARRWVFLLAISLLNCSNATINWLSLVYLVVSTPFGVAAIWILDSVGLRAALGVYTIPAGVVCLLSTICLWESVPPTPPSAGAASSTSEKFLDGLKLQLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 48229 - protein, 559 aa, Homo sapiens
  Payload ID: 9757
  Gene Symbol: MFSD7
  Gene Name: major facilitator superfamily domain containing 7
  Uniprot ID: Q6UXD7
  ENSP ID: ENSP00000320234
MAGPTEAETGLAEPRALCAQRGHRTYARRWVFLLAISLLNCSNATLWLSFAPVADVIAEDLVLSMEQINWLSLVYLVVSTPFGVAAIWILDSVGLRAATILGAWLNFAGSVLRMVPCMVVGTQNPFAFLMGGQSLCALAQSLVIFSPAKLAALWFPEHQRATANMLATMSNPLGVLVANVLSPVLVKKGEDIPLMLGVYTIPAGVVCLLSTICLWESVPPTPPSAGAASSTSEKFLDGLKLLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 48230 - protein, 560 aa, Homo sapiens
  Payload ID: 9757
  Gene Symbol: MFSD7
  Gene Name: major facilitator superfamily domain containing 7
  Uniprot ID: Q6UXD7
  ENSP ID: ENSP00000384616
MAGPTEAETGLAEPRALCAQRGHRTYARRWVFLLAISLLNCSNATLWLSFAPVADVIAEDLVLSMEQINWLSLVYLVVSTPFGVAAIWILDSVGLRAATILGAWLNFAGSVLRMVPCMVVGTQNPFAFLMGGQSLCALAQSLVIFSPAKLAALWFPEHQRATANMLATMSNPLGVLVANVLSPVLVKKGEDIPLMLGVYTIPAGVVCLLSTICLWESVPPTPPSAGAASSTSEKFLDGLKLQLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 48231 - protein, 463 aa, Homo sapiens
  Payload ID: 9757
  Gene Symbol: MFSD7
  Gene Name: major facilitator superfamily domain containing 7
  ENSP ID: ENSP00000423204
MAGPTEAETGLAEPRALCAQRGHRTYARRWVFLLAISLLNCSNATLWLSFAPVADVIAEDLVLSMEQINWLSLVYLVVSTPFGVAAIWILDSVGLRAALGVYTIPAGVVCLLSTICLWESVPPTPPSAGAASSTSEKFLDGLKLQLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 48232 - protein, 217 aa, Homo sapiens
  Payload ID: 9757
  Gene Symbol: MFSD7
  Gene Name: major facilitator superfamily domain containing 7
  ENSP ID: ENSP00000424556
MEQINWLSLVYLVVSTPFGVAAIWILDSVGLRAATILGAWLNFAGSVLRMVPCMVVGTQNPFAFLMGGQSLCALAQSLVIFSPAKLAALWFPEHQRATANMLATMSNPLGVLVANVLSPVLVKKGEDIPLMLGVYTIPAGVVCLLSTICLWESVPPTPPSAGAASSTSEKFLDGLKLQLMWNKAYVILAVCLGGMIGISASFSALLEQILCASGHSS

SEQ ID NO: 48233 - protein, 199 aa, Homo sapiens
  Payload ID: 9757
  Gene Symbol: MFSD7
  Gene Name: major facilitator superfamily domain containing 7
  ENSP ID: ENSP00000425038
MAGPTEAETGLAEPRALCAQRGHRTYARRWVFLLAISLLNCSNATLWLSFAPVADVIAEDLVLSMEQINWLSLVYLVVSTPFGVAAIWILDSVGLRAAGFSGLCGALFITFGILGALALGPYVDRTKHFTEATKIGLCLFSLACVPFALVSQLQGQTLALAATCSLLGLFGFSVGPVAMELAVECSFPVGEGAATGMIF

SEQ ID NO: 48234 - protein, 420 aa, Homo sapiens
  Payload ID: 9757
  Gene Symbol: MFSD7
  Gene Name: major facilitator superfamily domain containing 7
  ENSP ID: ENSP00000425753
MEQINWLSLVYLVVSTPFGVAAIWILDSVGLRAATILGAWLNFAGSVLRMVPCMVVGTQNPFAFLMGGQSLCALAQSLVIFSPAKLAALWFPEHQRATANMLATMSNPLGVLVANVLSPVLVKKGEDIPLMLGVYTIPAGVVCLLSTICLWESVPPTPPSAGAASSTSEKFLDGLKLLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTAASWRSSSTPHTGACRPSLGSPPPPVTPWAAQTQGRVWTEGEQEGLGSWGPARRLRSARRGGPR

SEQ ID NO: 48235 - protein, 518 aa, Homo sapiens
  Payload ID: 9758
  Gene Symbol: MFSD8
  Gene Name: major facilitator superfamily domain containing 8
  Uniprot ID: Q8NHS3
  ENSP ID: ENSP00000296468
MAGLRNESEQEPLLGDTPGSREWDILETEEHYKSRWRSIRILYLTMFLSSVGFSVVMMSIWPYLQKIDPTADTSFLGWVIASYSLGQMVASPIFGLWSNYRPRKEPLIVSILISVAANCLYAYLHIPASHNKYYMLVARGLLGIGAGNVAVVRSYTAGATSLQERTSSMANISMCQALGFILGPVFQTCFTFLGEKGVTWDVIKLQINMYTTPVLLSAFLGILNIILILAILREHRVDDSGRQCKSINFEEASTDEAQVPQGNIDQVAVVAINVLFFVTLFIFALFETIITPLTMDMYAWTQEQAVLYNGIILAALGVEAVVIFLGVKLLSKKIGERAILLGGLIVVWVGFFILLPWGNQFPKIQWEDLHNNSIPNTTFGEIIIGLWKSPMEDDNERPTGCSIEQAWCLYTPVIHLAQFLTSAVLIGLGYPVCNLMSYTLYSKILGPKPQGVYMGWLTASGSGARILGPMFISQVYAHWGPRWAFSLVCGIIVLTITLLGVVYKRLIALSVRYGRIQE

SEQ ID NO: 48236 - protein, 153 aa, Homo sapiens
  Payload ID: 9758
  Gene Symbol: MFSD8
  Gene Name: major facilitator superfamily domain containing 8
  Uniprot ID: Q8NHS3
  ENSP ID: ENSP00000421176
MFLSSVGFSVVMMSIWPYLQKIDPTADTSFLGWVIASYSLGQMVASPIFGLWSNYRPRKEPLIVSILISVAANCLYAYLHIPASHNKYYMLVARGLLGIGAVFQTCFTFLGEKGVTWDVIKLQINMYTTPVLLSAFLGILNIILILAILSKYR

SEQ ID NO: 48237 - protein, 473 aa, Homo sapiens
  Payload ID: 9758
  Gene Symbol: MFSD8
  Gene Name: major facilitator superfamily domain containing 8
  ENSP ID: ENSP00000425000
MFLSSVGFSVVMMSIWPYLQKIDPTADTSFLGWVIASYSLGQMVASPIFGLWSNYRPRKEPLIVSILISVAANCLYAYLHIPASHNKYYMLVARGLLGIGAGNVAVVRSYTAGATSLQERTSSMANISMCQALGFILGPVFQTCFTFLGEKGVTWDVIKLQINMYTTPVLLSAFLGILNIILILAILREHRVDDSGRQCKSINFEEASTDEAQVPQGNIDQVAVVAINVLFFVTLFIFALFETIITPLTMDMYAWTQEQAVLYNGIILAALGVEAVVIFLGVKLLSKKIGERAILLGGLIVVWVGFFILLPWGNQFPKIQWEDLHNNSIPNTTFGEIIIGLWKSPMEDDNERPTGCSIEQAWCLYTPVIHLAQFLTSAVLIGLGYPVCNLMSYTLYSKILGPKPQGVYMGWLTASGSGARILGPMFISQVYAHWGPRWAFSLVCGIIVLTITLLGVVYKRLIALSVRYGRIQE

SEQ ID NO: 48238 - protein, 474 aa, Homo sapiens
  Payload ID: 9759
  Gene Symbol: MFSD9
  Gene Name: major facilitator superfamily domain containing 9
  Uniprot ID: Q8NBP5
  ENSP ID: ENSP00000258436
MELGGHWDMNSAPRLVSETAERKQEQKTGTEAEAADSGAVGARRFLLCLYLVGFLDLFGVSMVVPLLSLHVKSLGASPTVAGIVGSSYGILQLFSSTLVGCWSDVVGRRSSLLACILLSALGYLLLGAATNVFLFVLARVPAGIFKHTLSISRALLSDVVPEKERPLVIGHFNTASGVGFILGPVVGGYLTELEDGFYLTAFICFLVFILNAGLVWFFPWREAKPGSTEKGLPLRKTHVLLGRSHDTVQEAATSRRARASKKTAQPWVEVVLALRNMKNLLFSEMWDIFLVRLLMAMAVMLYYSNFVLALEERFGVRPKVTGYLISYSSMLGAVAGLALGPILRLYKHNSQALLLHSSILTCTLLLLYSLAPTMGAVVLSSTLLSFSTAIGRTCITDLQLTVGGAQASGTLIGVGQSVTAVGRIIAPLLSGVAQEVSPCGPPSLGAVLALVAIFIMSLNKRHSSGDGNSKLKSE

SEQ ID NO: 48239 - protein, 92 aa, Homo sapiens
  Payload ID: 9759
  Gene Symbol: MFSD9
  Gene Name: major facilitator superfamily domain containing 9
  ENSP ID: ENSP00000392605
MELGGHWDMNSAPRLVSETAERKQEQKTGTEAEAADSGAVGARRFLLCLYLVGFLDLFGVSMVVPLLSLHVKSLGASPTVAGIVDDVCSKRF

SEQ ID NO: 48240 - protein, 66 aa, Homo sapiens
  Payload ID: 9759
  Gene Symbol: MFSD9
  Gene Name: major facilitator superfamily domain containing 9
  ENSP ID: ENSP00000402411
MELGGHWDMNSAPRLVSETAERKQEQKTGTEAEAADSGAVGARRFLLCLYLVGFLVSASVGAGSKC

SEQ ID NO: 48241 - protein, 92 aa, Homo sapiens; identical to SEQ ID NO: 48239
  Payload ID: 9759
  Gene Symbol: MFSD9
  Gene Name: major facilitator superfamily domain containing 9
  ENSP ID: ENSP00000408630

SEQ ID NO: 48242 - protein, 79 aa, Homo sapiens
  Payload ID: 9759
  Gene Symbol: MFSD9
  Gene Name: major facilitator superfamily domain containing 9
  ENSP ID: ENSP00000413641
TVAGIVGSSYGILQLFSSTLVGCWSDVVGRRSSLLACILLSALGYLLLGAATNVFLFVLARVPAGLYFLMWFQRRNGRL

SEQ ID NO: 48243 - protein, 98 aa, Homo sapiens
  Payload ID: 9759
  Gene Symbol: MFSD9
  Gene Name: major facilitator superfamily domain containing 9
  ENSP ID: ENSP00000414870
MELGGHWDMNSAPRLVSETAERKQEQKTGTEAEAADSGAVGARRFLLCLYLVGFLHGCAFIEPSCQVPWSKSNSCWNSRRRMFKEILRFEHYNQVPCH

SEQ ID NO: 48244 - protein, 299 aa, Homo sapiens
  Payload ID: 9760
  Gene Symbol: HLA-A
  Gene Name: major histocompatibility complex, class I, A
  ENSP ID: ENSP00000365998
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWV

SEQ ID NO: 48245 - protein, 371 aa, Homo sapiens
  Payload ID: 9760
  Gene Symbol: HLA-A
  Gene Name: major histocompatibility complex, class I, A
  ENSP ID: ENSP00000366002
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSGGEGVKDRKGGSYTQAASSDSAQGSDVSLTACKV

SEQ ID NO: 48246 - protein, 365 aa, Homo sapiens
  Payload ID: 9760
  Gene Symbol: HLA-A
  Gene Name: major histocompatibility complex, class I, A
  Uniprot ID: P04439
  ENSP ID: ENSP00000366005
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 48247 - protein, 299 aa, Homo sapiens
  Payload ID: 9760
  Gene Symbol: HLA-A
  Gene Name: major histocompatibility complex, class I, A
  ENSP ID: ENSP00000366018
MAVMAPRTLVLLLSGALALTQTWAGSHSMRYFYTSVSRPGRGEPRFIAVGYVDDTQFVRFDSDAASQRMEPRAPWIEQEGPEYWDRNTRNVKAHSQTDRANLGTLRGYYNQSEDGSHTIQRMYGCDVGPDGRFLRGYQQDAYDGKDYIALNEDLRSWTAADMAAQITQRKWETAHEAEQWRAYLEGRCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWV

SEQ ID NO: 48248 - protein, 365 aa, Homo sapiens
  Payload ID: 9760
  Gene Symbol: HLA-A
  Gene Name: major histocompatibility complex, class I, A
  Uniprot ID: P18462
  ENSP ID: ENSP00000373100
MAVMAPRTLVLLLSGALALTQTWAGSHSMRYFYTSVSRPGRGEPRFIAVGYVDDTQFVRFDSDAASQRMEPRAPWIEQEGPEYWDRNTRNVKAHSQTDRANLGTLRGYYNQSEDGSHTIQRMYGCDVGPDGRFLRGYQQDAYDGKDYIALNEDLRSWTAADMAAQITQRKWETAHEAEQWRAYLEGRCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVIAGAVVAAVMWRRKSSDRKGGSYSQAASSDSAQGSDMSLTACKV

SEQ ID NO: 48249 - protein, 371 aa, Homo sapiens
  Payload ID: 9760
  Gene Symbol: HLA-A
  Gene Name: major histocompatibility complex, class I, A
  ENSP ID: ENSP00000373114
MAVMAPRTLVLLLSGALALTQTWAGSHSMRYFYTSVSRPGRGEPRFIAVGYVDDTQFVRFDSDAASQRMEPRAPWIEQEGPEYWDRNTRNVKAHSQTDRANLGTLRGYYNQSEDGSHTIQRMYGCDVGPDGRFLRGYQQDAYDGKDYIALNEDLRSWTAADMAAQITQRKWETAHEAEQWRAYLEGRCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVIAGAVVAAVMWRRKSSGGEGMKDRKGGSYSQAASSDSAQGSDMSLTACKV

SEQ ID NO: 48250 - protein, 365 aa, Homo sapiens; identical to SEQ ID NO: 48246
  Payload ID: 9760
  Gene Symbol: HLA-A
  Gene Name: major histocompatibility complex, class I, A
  Uniprot ID: P04439
  ENSP ID: ENSP00000379873

SEQ ID NO: 48251 - protein, 371 aa, Homo sapiens
  Payload ID: 9760
  Gene Symbol: HLA-A
  Gene Name: major histocompatibility complex, class I, A
  ENSP ID: ENSP00000388526
MAVMAPRTLVLLLSGALALTQTWAGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWEPSSQPTIPIVGIIAGLVLFGAVITGAVVAAVMWRRKSSGGEGVKDRKGGSYSQAASSDSAQGSDVSLTACKV

SEQ ID NO: 48252 - protein, 371 aa, Homo sapiens
  Payload ID: 9760
  Gene Symbol: HLA-A
  Gene Name: major histocompatibility complex, class I, A
  ENSP ID: ENSP00000388724
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSGGEGVKDRKGGSYTQAASSDSAQGSDVSLTACKV

SEQ ID NO: 48253 - protein, 299 aa, Homo sapiens
  Payload ID: 9760
  Gene Symbol: HLA-A
  Gene Name: major histocompatibility complex, class I, A
  ENSP ID: ENSP00000390225
  MOD_RES (1)..(1): Any amino acid
XAVMAPRTLVLLLSGALALTQTWAGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWV

SEQ ID NO: 48254 - protein, 299 aa, Homo sapiens
  Payload ID: 9760
  Gene Symbol: HLA-A
  Gene Name: major histocompatibility complex, class I, A
  ENSP ID: ENSP00000391738
MAVMAPRTLLLLLLGALALTQTWAGSHSMRYFTTSVSRPGRGEPRFIAVGYVDDTQFVRFDSDAASQRMEPRAPWIEQEGPEYWDLQTRNVKAQSQTDRANLGTLRGYYNQSEAGSHTIQMMYGCDVGSDGRFLRGYRQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWV

SEQ ID NO: 48255 - protein, 299 aa, Homo sapiens
  Payload ID: 9760
  Gene Symbol: HLA-A
  Gene Name: major histocompatibility complex, class I, A
  ENSP ID: ENSP00000392547
MAVMAPRTLVLLLSGALALTQTWAGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWV

SEQ ID NO: 48256 - protein, 299 aa, Homo sapiens
  Payload ID: 9760
  Gene Symbol: HLA-A
  Gene Name: major histocompatibility complex, class I, A
  ENSP ID: ENSP00000394582
MAVMAPRTLLLLLLGALALTQTWAGSHSMRYFFTSVSRPGRGEPRFIAVGYVDDTQFVRFDSDAASQRMEPRAPWIEQEGPEYWDQETRNVKAHSQTDRESLRIALRYYNQSEAGSHTIQMMYGCDVGPDGRLLRGYQQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWV

SEQ ID NO: 48257 - protein, 299 aa, Homo sapiens
  Payload ID: 9760
  Gene Symbol: HLA-A
  Gene Name: major histocompatibility complex, class I, A
  ENSP ID: ENSP00000394889
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWV

SEQ ID NO: 48258 - protein, 299 aa, Homo sapiens; identical to SEQ ID NO: 48257
  Payload ID: 9760
  Gene Symbol: HLA-A
  Gene Name: major histocompatibility complex, class I, A
  ENSP ID: ENSP00000397962

SEQ ID NO: 48259 - protein, 371 aa, Homo sapiens; identical to SEQ ID NO: 48252
  Payload ID: 9760
  Gene Symbol: HLA-A
  Gene Name: major histocompatibility complex, class I, A
  ENSP ID: ENSP00000398188

SEQ ID NO: 48260 - protein, 365 aa, Homo sapiens [sequence omitted]

SEQ ID NO: 48261 - protein, 365 aa, Homo sapiens
  Payload ID: 9760
  Gene Symbol: HLA-A
  Gene Name: major histocompatibility complex, class I, A
  ENSP ID: ENSP00000403922
  MOD_RES (1)..(1): Any amino acid
XAVMAPRTLVLLLSGALALTQTWAGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWEPSSQPTIPIVGIIAGLVLFGAVITGAVVAAVMWRRKSSDRKGGSYSQAASSDSAQGSDVSLTACKV

SEQ ID NO: 48262 - protein, 365 aa, Homo sapiens
  Payload ID: 9760
  Gene Symbol: HLA-A
  Gene Name: major histocompatibility complex, class I, A
  Uniprot ID: P30443
  ENSP ID: ENSP00000404678
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 48263 - protein, 365 aa, Homo sapiens; identical to SEQ ID NO: 48262
  Payload ID: 9760
  Gene Symbol: HLA-A
  Gene Name: major histocompatibility complex, class I, A
  Uniprot ID: P30443
  ENSP ID: ENSP00000406366

SEQ ID NO: 48264 - protein, 365 aa, Homo sapiens
  Payload ID: 9760
  Gene Symbol: HLA-A
  Gene Name: major histocompatibility complex, class I, A
  Uniprot ID: P30512
  ENSP ID: ENSP00000408986
MAVMAPRTLLLLLLGALALTQTWAGSHSMRYFTTSVSRPGRGEPRFIAVGYVDDTQFVRFDSDAASQRMEPRAPWIEQEGPEYWDLQTRNVKAQSQTDRANLGTLRGYYNQSEAGSHTIQMMYGCDVGSDGRFLRGYRQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVFAGAVVAAVRWRRKSSDRKGGSYSQAASSDSAQGSDMSLTACKV

SEQ ID NO: 48265 - protein, 365 aa, Homo sapiens
  Payload ID: 9760
  Gene Symbol: HLA-A
  Gene Name: major histocompatibility complex, class I, A
  Uniprot ID: P30447
  ENSP ID: ENSP00000410645
MAVMAPRTLLLLLLGALALTQTWAGSHSMRYFFTSVSRPGRGEPRFIAVGYVDDTQFVRFDSDAASQRMEPRAPWIEQEGPEYWDQETRNVKAHSQTDRESLRIALRYYNQSEAGSHTIQMMYGCDVGPDGRLLRGYQQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAMFAGAVVAAVRWRRKSSDRKGGSYSQAASSDSAQGSDMSLTACKV

SEQ ID NO: 48266 - protein, 371 aa, Homo sapiens
  Payload ID: 9760
  Gene Symbol: HLA-A
  Gene Name: major histocompatibility complex, class I, A
  ENSP ID: ENSP00000416233
  MOD_RES (1)..(1): Any amino acid
XAVMAPRTLVLLLSGALALTQTWAGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWEPSSQPTIPIVGIIAGLVLFGAVITGAVVAAVMWRRKSSGGEGVKDRKGGSYSQAASSDSAQGSDVSLTACKV

SEQ ID NO: 48267 - protein, 342 aa, Homo sapiens
  Payload ID: 9760
  Gene Symbol: HLA-A
  Gene Name: major histocompatibility complex, class I, A
  ENSP ID: ENSP00000432736
MAVMAPRTLLLLLLGALALTQTWAGSHSMRYFTTSVSRPGRGEPRFIAVGYVDDTQFVRFDSDAASQRMEPRAPWIEQEGPEYWDLQTRNVKAQSQTDRANLGTLRGYYNQSEAGSHTIQMMYGCDVGSDGRFLRGYRQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVFAGAVVAAVRWRRKSSGGVKG

SEQ ID NO: 48268 - protein, 365 aa, Homo sapiens; identical to SEQ ID NO: 48262
  Payload ID: 9760
  Gene Symbol: HLA-A
  Gene Name: major histocompatibility complex, class I, A
  Uniprot ID: P30443
  ENSP ID: ENSP00000447614

SEQ ID NO: 48269 - protein, 365 aa, Homo sapiens; identical to SEQ ID NO: 48262
  Payload ID: 9760
  Gene Symbol: HLA-A
  Gene Name: major histocompatibility complex, class I, A
  Uniprot ID: P30443
  ENSP ID: ENSP00000447635

SEQ ID NO: 48270 - protein, 365 aa, Homo sapiens [sequence omitted]

SEQ ID NO: 48271 - protein, 365 aa, Homo sapiens; identical to SEQ ID NO: 48248
  Payload ID: 9760
  Gene Symbol: HLA-A
  Gene Name: major histocompatibility complex, class I, A
  Uniprot ID: P30450
  ENSP ID: ENSP00000447990

SEQ ID NO: 48272 - protein, 365 aa, Homo sapiens [sequence omitted]

SEQ ID NO: 48273 - protein, 394 aa, Homo sapiens
  Payload ID: 9760
  Gene Symbol: HLA-A
  Gene Name: major histocompatibility complex, class I, A
  ENSP ID: ENSP00000448516
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKGESLEGLMCVGCWVEQWTQLCYGVSLRWMY

SEQ ID NO: 48274 - protein, 365 aa, Homo sapiens; identical to SEQ ID NO: 48265
  Payload ID: 9760
  Gene Symbol: HLA-A
  Gene Name: major histocompatibility complex, class I, A
  Uniprot ID: P10314
  ENSP ID: ENSP00000448992

SEQ ID NO: 48275 - protein, 394 aa, Homo sapiens; identical to SEQ ID NO: 48273
  Payload ID: 9760
  Gene Symbol: HLA-A
  Gene Name: major histocompatibility complex, class I, A
  ENSP ID: ENSP00000449453

SEQ ID NO: 48276 - protein, 365 aa, Homo sapiens; identical to SEQ ID NO: 48264
  Payload ID: 9760
  Gene Symbol: HLA-A
  Gene Name: major histocompatibility complex, class I, A
  ENSP ID: ENSP00000450169

SEQ ID NO: 48277 - protein, 326 aa, Homo sapiens
  Payload ID: 9760
  Gene Symbol: HLA-A
  Gene Name: major histocompatibility complex, class I, A
  ENSP ID: ENSP00000480039
MAVMAPRTLLLLLLGALALTQTWAGSHSMRYFFTSVSRPGRGEPRFIAVGYVDDTQFVRFDSDAASQRMEPRAPWIEQEGPEYWDQETRNVKAHSQTDRESLRIALRYYNQSEAGSHTIQMMYGCDVGPDGRLLRGYQQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWDRKGGSYSQAASSDSAQGSDMSLTACKV

SEQ ID NO: 48278 - protein, 339 aa, Homo sapiens
  Payload ID: 9760
  Gene Symbol: HLA-A
  Gene Name: major histocompatibility complex, class I, A
  ENSP ID: ENSP00000482354
MVLMAPRTLLLLLSGALALTQTWARSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWEPSSQPTIPIVGIIAGLVLFGAVITGAVVAAVMWRRKSSDR

SEQ ID NO: 48279 - protein, 394 aa, Homo sapiens
  Payload ID: 9760
  Gene Symbol: HLA-A
  Gene Name: major histocompatibility complex, class I, A
  ENSP ID: ENSP00000483385
MAVMAPRTLVLLLSGALALTQTWAGSHSMRYFYTSVSRPGRGEPRFIAVGYVDDTQFVRFDSDAASQRMEPRAPWIEQEGPEYWDRNTRNVKAHSQTDRANLGTLRGYYNQSEDGSHTIQRMYGCDVGPDGRFLRGYQQDAYDGKDYIALNEDLRSWTAADMAAQITQRKWETAHEAEQWRAYLEGRCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVIAGAVVAAVMWRRKSSDRKGGSYSQAASSDSAQGSDMSLTACKGESLEGLMCVGCWAEQWTQLCYGVSLHWMY

SEQ ID NO: 48280 - protein, 362 aa, Homo sapiens
  Payload ID: 9761
  Gene Symbol: HLA-B
  Gene Name: major histocompatibility complex, class I, B
  Uniprot ID: P30466
  ENSP ID: ENSP00000352656
MRVTAPRTLLLLLWGAVALTETWAGSHSMRYFHTSVSRPGRGEPRFISVGYVDGTQFVRFDSDAASPRTEPRAPWIEQEGPEYWDRNTQISKTNTQTYRESLRNLRGYYNQSEAGSHTLQRMYGCDVGPDGRLLRGHDQSAYDGKDYIALNEDLSSWTAADTAAQITQRKWEAARVAEQLRAYLEGTCVEWLRRHLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGGKGGSYSQAASSDSAQGSDVSLTA

SEQ ID NO: 48281 - protein, 362 aa, Homo sapiens
  Payload ID: 9761
  Gene Symbol: HLA-B
  Gene Name: major histocompatibility complex, class I, B
  Uniprot ID: P30464
  ENSP ID: ENSP00000388208
MRVTAPRTVLLLLSGALALTETWAGSHSMRYFYTAMSRPGRGEPRFIAVGYVDDTQFVRFDSDAASPRMAPRAPWIEQEGPEYWDRETQISKTNTQTYRESLRNLRGYYNQSEAGSHTLQRMYGCDVGPDGRLLRGHDQSAYDGKDYIALNEDLSSWTAADTAAQITQRKWEAAREAEQWRAYLEGLCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGGKGGSYSQAASSDSAQGSDVSLTA

SEQ ID NO: 48282 - protein, 241 aa, Homo sapiens
  Payload ID: 9761
  Gene Symbol: HLA-B
  Gene Name: major histocompatibility complex, class I, B
  ENSP ID: ENSP00000392099
  MOD_RES (1)..(1): Any amino acid
XPDGRLLRGHNQYAYDGKDYIALNEDLRSWTAADTAAQITQRKWEAARVAEQDRAYLEGTCVEWLRRYLENGKDTLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGHFLPTGGKGGSYSQAACSDSAQGSDVSLTA

SEQ ID NO: 48283 - protein, 246 aa, Homo sapiens
  Payload ID: 9761
  Gene Symbol: HLA-B
  Gene Name: major histocompatibility complex, class I, B
  ENSP ID: ENSP00000392235
MASVGRSEGTAGGGAGPGEPRREEGRAGLSPSSPPGSHSMRYFYTAMSRPGRGEPRFIAVGYVDDTQFVRFDSDAASPRMAPRAPWIEQEGPEYWDRETQISKTNTQTYRESLRNLRGYYNQSEAGSHTLQRMYGCDVGPDGRLLRGHDQSAYDGKDYIALNEDLSSWTAADTAAQITQRKWEAAREAEQWRAYLEGLCVEWLRRYLENGKETLQRADPPKTHVTHHPISDHEATLRCWALGFYPA

SEQ ID NO: 48284 - protein, 246 aa, Homo sapiens
  Payload ID: 9761
  Gene Symbol: HLA-B
  Gene Name: major histocompatibility complex, class I, B
  ENSP ID: ENSP00000396397
MASVGRREGTAGGGAGPGEPRREEGRAGLSPSSPPGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQDRAYLEGLCVESLRRYLENGKETLQRADPPKTHVTHHPISDHEVTLRCWALGFYPA

SEQ ID NO: 48285 - protein, 241 aa, Homo sapiens
  Payload ID: 9761
  Gene Symbol: HLA-B
  Gene Name: major histocompatibility complex, class I, B
  ENSP ID: ENSP00000398100
  MOD_RES (1)..(1): Any amino acid
XPDGRLLRGYDQDAYDGKDYIALNEDLSSWTAADTAAQITQRKWEAARVAEQDRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGHFLPTGGKGGSYSQAACSDSAQGSDVSLTA

SEQ ID NO: 48286 - protein, 362 aa, Homo sapiens
  Payload ID: 9761
  Gene Symbol: HLA-B
  Gene Name: major histocompatibility complex, class I, B
  Uniprot ID: P01889
  ENSP ID: ENSP00000399168
MLVMAPRTVLLLLSAALALTETWAGSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 48287 - protein, 246 aa, Homo sapiens
  Payload ID: 9761
  Gene Symbol: HLA-B
  Gene Name: major histocompatibility complex, class I, B
  ENSP ID: ENSP00000399675
MASAGRSEGTAGGGAGPEEPRREEGRAGLSPSSPPGSHSMRYFDTAMSRPGRGEPRFISVGYVDDTQFVRFDSDAASPREEPRAPWIEQEGPEYWDRNTQIFKTNTQTDRESLRNLRGYYNQSEAGSHTLQSMYGCDVGPDGRLLRGHNQYAYDGKDYIALNEDLRSWTAADTAAQITQRKWEAARVAEQDRAYLEGTCVEWLRRYLENGKDTLERADPPKTHVTHHPISDHEATLRCWALGFYPA

SEQ ID NO: 48288 - protein, 362 aa, Homo sapiens
  Payload ID: 9761
  Gene Symbol: HLA-B
  Gene Name: major histocompatibility complex, class I, B
  Uniprot ID: P30460
  ENSP ID: ENSP00000400842
MLVMAPRTVLLLLSAALALTETWAGSHSMRYFDTAMSRPGRGEPRFISVGYVDDTQFVRFDSDAASPREEPRAPWIEQEGPEYWDRNTQIFKTNTQTDRESLRNLRGYYNQSEAGSHTLQSMYGCDVGPDGRLLRGHNQYAYDGKDYIALNEDLRSWTAADTAAQITQRKWEAARVAEQDRAYLEGTCVEWLRRYLENGKDTLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 48289 - protein, 241 aa, Homo sapiens
  Payload ID: 9761
  Gene Symbol: HLA-B
  Gene Name: major histocompatibility complex, class I, B
  ENSP ID: ENSP00000401443
  MOD_RES (1)..(1): Any amino acid
XPDGRLLRGHDQSAYDGKDYIALNEDLSSWTAADTAAQITQRKWEAAREAEQWRAYLEGLCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGHFLPTGGKGGSYSQAASSDSAQGSDVSLTA

SEQ ID NO: 48290 - protein, 241 aa, Homo sapiens
  Payload ID: 9761
  Gene Symbol: HLA-B
  Gene Name: major histocompatibility complex, class I, B
  ENSP ID: ENSP00000403471
  MOD_RES (1)..(1): Any amino acid
XPDGRLLRGYDQDAYDGKDYIALNEDLSSWTAADTAAQITQRKWEAARVAEQLRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGHFLPTGGKGGSYSQAACSDSAQGSDVSLTA

SEQ ID NO: 48291 - protein, 362 aa, Homo sapiens
  Payload ID: 9761
  Gene Symbol: HLA-B
  Gene Name: major histocompatibility complex, class I, B
  Uniprot ID: P30461
  ENSP ID: ENSP00000405178
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQLRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 48292 - protein, 362 aa, Homo sapiens
  Payload ID: 9761
  Gene Symbol: HLA-B
  Gene Name: major histocompatibility complex, class I, B
  Uniprot ID: P30481
  ENSP ID: ENSP00000405365
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQDRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 48293 - protein, 246 aa, Homo sapiens
  Payload ID: 9761
  Gene Symbol: HLA-B
  Gene Name: major histocompatibility complex, class I, B
  ENSP ID: ENSP00000405931
MASAGRSEGTAGGGAGPEEPRREEGRAGLSPSSPPGSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPA

SEQ ID NO: 48294 - protein, 241 aa, Homo sapiens
  Payload ID: 9761
  Gene Symbol: HLA-B
  Gene Name: major histocompatibility complex, class I, B
  ENSP ID: ENSP00000411954
  MOD_RES (1)..(1): Any amino acid
XPDGRLLRGHDQSAYDGKDYIALNEDLSSWTAADTAAQITQRKWEAARVAEQLRAYLEGTCVEWLRRHLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGHFLPTGGKGGSYSQAASSDSAQGSDVSLTA

SEQ ID NO: 48295 - protein, 246 aa, Homo sapiens
  Payload ID: 9761
  Gene Symbol: HLA-B
  Gene Name: major histocompatibility complex, class I, B
  ENSP ID: ENSP00000416672
MASVGRREGTAGGGAGPGEPRREEGRAGLSPSSPPGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQLRAYLEGLCVESLRRYLENGKETLQRADPPKTHVTHHPISDHEVTLRCWALGFYPA

SEQ ID NO: 48296 - protein, 224 aa, Homo sapiens
  Payload ID: 9761
  Gene Symbol: HLA-B
  Gene Name: major histocompatibility complex, class I, B
  ENSP ID: ENSP00000433363
MRVTAPRTLLLLLWGAVALTETWAGSHSMRYFHTSVSRPGRGEPRFISVGYVDGTQFVRFDSDAASPRTEPRAPWIEQEGPEYWDRNTQISKTNTQTYRESLRNLRGYYNQSEAGSHTLQRMYGCDVGPDGRLLRGHDQSAYDGKDYIALNEDLSSWTAADTAAQITQRKWEAARVAEQLRAYLEGTCVEWLRRHLENGKETLQRADQEQKSLFPAQRLELSNE

SEQ ID NO: 48297 - protein, 224 aa, Homo sapiens
  Payload ID: 9761
  Gene Symbol: HLA-B
  Gene Name: major histocompatibility complex, class I, B
  ENSP ID: ENSP00000435083
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQDRAYLEGLCVESLRRYLENGKETLQRADQEQKSLFPAQRLELSNE

SEQ ID NO: 48298 - protein, 224 aa, Homo sapiens
  Payload ID: 9761
  Gene Symbol: HLA-B
  Gene Name: major histocompatibility complex, class I, B
  ENSP ID: ENSP00000435221
MRVTAPRTVLLLLSGALALTETWAGSHSMRYFYTAMSRPGRGEPRFIAVGYVDDTQFVRFDSDAASPRMAPRAPWIEQEGPEYWDRETQISKTNTQTYRESLRNLRGYYNQSEAGSHTLQRMYGCDVGPDGRLLRGHDQSAYDGKDYIALNEDLSSWTAADTAAQITQRKWEAAREAEQWRAYLEGLCVEWLRRYLENGKETLQRADQEQKSLFPAQRLELSNE

SEQ ID NO: 48299 - protein, 224 aa, Homo sapiens
  Payload ID: 9761
  Gene Symbol: HLA-B
  Gene Name: major histocompatibility complex, class I, B
  ENSP ID: ENSP00000435817
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQLRAYLEGLCVESLRRYLENGKETLQRADQEQKSLFPAQRLELSNE

SEQ ID NO: 48300 - protein, 224 aa, Homo sapiens
  Payload ID: 9761
  Gene Symbol: HLA-B
  Gene Name: major histocompatibility complex, class I, B
  ENSP ID: ENSP00000436637
MLVMAPRTVLLLLSAALALTETWAGSHSMRYFDTAMSRPGRGEPRFISVGYVDDTQFVRFDSDAASPREEPRAPWIEQEGPEYWDRNTQIFKTNTQTDRESLRNLRGYYNQSEAGSHTLQSMYGCDVGPDGRLLRGHNQYAYDGKDYIALNEDLRSWTAADTAAQITQRKWEAARVAEQDRAYLEGTCVEWLRRYLENGKDTLERADQEQKSLFPAQRLELSNE

SEQ ID NO: 48301 - protein, 366 aa, Homo sapiens
  Payload ID: 9762
  Gene Symbol: HLA-C
  Gene Name: major histocompatibility complex, class I, C
  Uniprot ID: P10321
  ENSP ID: ENSP00000365402
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 48302 - protein, 131 aa, Homo sapiens
  Payload ID: 9762
  Gene Symbol: HLA-C
  Gene Name: major histocompatibility complex, class I, C
  ENSP ID: ENSP00000365412
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDEDVWLRPGARRAPPPRV

SEQ ID NO: 48303 - protein, 372 aa, Homo sapiens
  Payload ID: 9762
  Gene Symbol: HLA-C
  Gene Name: major histocompatibility complex, class I, C
  ENSP ID: ENSP00000372813
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWGPSSQPTIPIVGIVAGLAVLAVLAVLGAVMAVVMCRRKSSGHFLPTGGKGGSCSQAASSNSAQGSDESLIACKA

SEQ ID NO: 48304 - protein, 372 aa, Homo sapiens
  Payload ID: 9762
  Gene Symbol: HLA-C
  Gene Name: major histocompatibility complex, class I, C
  ENSP ID: ENSP00000372819
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGHFLPTGGKGGSCSQAACSNSAQGSDESLITCKA

SEQ ID NO: 48305 - protein, 397 aa, Homo sapiens
  Payload ID: 9762
  Gene Symbol: HLA-C
  Gene Name: major histocompatibility complex, class I, C
  ENSP ID: ENSP00000372975
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWGPSSQPTIPIVGIVAGLAVLAVLAVLGAVMAVVMCRRKSSGREGVRSGVWPATVPRALMSLSSLVKPETAACVGLRCRISSHLSFVTSRASGISFCKGI

SEQ ID NO: 48306 - protein, 372 aa, Homo sapiens; identical to SEQ ID NO: 48303
  Payload ID: 9762
  Gene Symbol: HLA-C
  Gene Name: major histocompatibility complex, class I, C
  ENSP ID: ENSP00000372979

SEQ ID NO: 48307 - protein, 366 aa, Homo sapiens
  Payload ID: 9762
  Gene Symbol: HLA-C
  Gene Name: major histocompatibility complex, class I, C
  Uniprot ID: P30504
  ENSP ID: ENSP00000383195
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWGPSSQPTIPIVGIVAGLAVLAVLAVLGAVMAVVMCRRKSSGGKGGSCSQAASSNSAQGSDESLIACKA

SEQ ID NO: 48308 - protein, 366 aa, Homo sapiens; identical to SEQ ID NO: 48307
  Payload ID: 9762
  Gene Symbol: HLA-C
  Gene Name: major histocompatibility complex, class I, C
  Uniprot ID: P30504
  ENSP ID: ENSP00000383244

SEQ ID NO: 48309 - protein, 397 aa, Homo sapiens; identical to SEQ ID NO: 48305
  Payload ID: 9762
  Gene Symbol: HLA-C
  Gene Name: major histocompatibility complex, class I, C
  ENSP ID: ENSP00000383245

SEQ ID NO: 48310 - protein, 372 aa, Homo sapiens
  Payload ID: 9762
  Gene Symbol: HLA-C
  Gene Name: major histocompatibility complex, class I, C
  ENSP ID: ENSP00000388708
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAGSHTLQWMYGCDLGPDGRLLRGYDQSAYDGKDYIALNEDLRSWTAADTAAQITQRKWEAARAAEQQRAYLEGTCVEWLRRYLENGKETLQRAEHPKTHVTHHLVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGHFLPTGGKGGSCSQAASSNSAQGSDESLIACKA

SEQ ID NO: 48311 - protein, 368 aa, Homo sapiens
  Payload ID: 9762
  Gene Symbol: HLA-C
  Gene Name: major histocompatibility complex, class I, C
  ENSP ID: ENSP00000389248
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSAACVGLRCRISSHLSFVTSRASGISFCKGV

SEQ ID NO: 48312 - protein, 397 aa, Homo sapiens
  Payload ID: 9762
  Gene Symbol: HLA-C
  Gene Name: major histocompatibility complex, class I, C
  ENSP ID: ENSP00000390282
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAGSHTLQWMYGCDLGPDGRLLRGYDQSAYDGKDYIALNEDLRSWTAADTAAQITQRKWEAARAAEQQRAYLEGTCVEWLRRYLENGKETLQRAEHPKTHVTHHLVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGREGVRSGVWPATVPRALMSLSSLVKPETAACVGLRCRISSHLSFVTSRASGISFCKGI

SEQ ID NO: 48313 - protein, 366 aa, Homo sapiens
  Payload ID: 9762
  Gene Symbol: HLA-C
  Gene Name: major histocompatibility complex, class I, C
  Uniprot ID: P04222
  ENSP ID: ENSP00000390851
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 48314 - protein, 339 aa, Homo sapiens
  Payload ID: 9762
  Gene Symbol: HLA-C
  Gene Name: major histocompatibility complex, class I, C
  ENSP ID: ENSP00000390860
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAGSHTLQWMYGCDLGPDGRLLRGYDQSAYDGKDYIALNEDLRSWTAADTAAQITQRKWEAARAAEQQRAYLEGTCVEWLRRYLENGKETLQRAEHPKTHVTHHLVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSA

SEQ ID NO: 48315 - protein, 261 aa, Homo sapiens
  Payload ID: 9762
  Gene Symbol: HLA-C
  Gene Name: major histocompatibility complex, class I, C
  ENSP ID: ENSP00000391250
  MOD_RES (1)..(1): Any amino acid
XRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEASRRWNLPEVGSCGGAFWRRAEIHVPCAARGAARAPHPE

SEQ ID NO: 48316 - protein, 366 aa, Homo sapiens
  Payload ID: 9762
  Gene Symbol: HLA-C
  Gene Name: major histocompatibility complex, class I, C
  Uniprot ID: P30499
  ENSP ID: ENSP00000393374
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAGSHTLQWMYGCDLGPDGRLLRGYDQSAYDGKDYIALNEDLRSWTAADTAAQITQRKWEAARAAEQQRAYLEGTCVEWLRRYLENGKETLQRAEHPKTHVTHHLVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 48317 - protein, 368 aa, Homo sapiens
  Payload ID: 9762
  Gene Symbol: HLA-C
  Gene Name: major histocompatibility complex, class I, C
  ENSP ID: ENSP00000393458
MRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVMAVVMCRRKSSAACVGLRCRISSHLSFVTSRASGISFCKGI

SEQ ID NO: 48318 - protein, 397 aa, Homo sapiens
  Payload ID: 9762
  Gene Symbol: HLA-C
  Gene Name: major histocompatibility complex, class I, C
  ENSP ID: ENSP00000397867
MRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVMAVVMCRRKSSGREGVRSGVWPATVPRALMSLSSLVKPETAACVGLRCRISSHLSFVTSRASGISFCKGI

SEQ ID NO: 48319 - protein, 368 aa, Homo sapiens
  Payload ID: 9762
  Gene Symbol: HLA-C
  Gene Name: major histocompatibility complex, class I, C
  ENSP ID: ENSP00000398169
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWGPSSQPTIPIVGIVAGLAVLAVLAVLGAVMAVVMCRRKSSAACVGLRCRISSHLSFVTSRASGISFCKGI

SEQ ID NO: 48320 - protein, 261 aa, Homo sapiens
  Payload ID: 9762
  Gene Symbol: HLA-C
  Gene Name: major histocompatibility complex, class I, C
  ENSP ID: ENSP00000400410
  MOD_RES (1)..(1): Any amino acid
XRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEASRRWNLPEVGSCGGAFWTRAEIHVPYAARGAARAPHPE

SEQ ID NO: 48321 - protein, 368 aa, Homo sapiens; identical to SEQ ID NO: 48319
  Payload ID: 9762
  Gene Symbol: HLA-C
  Gene Name: major histocompatibility complex, class I, C
  ENSP ID: ENSP00000403541

SEQ ID NO: 48322 - protein, 372 aa, Homo sapiens
  Payload ID: 9762
  Gene Symbol: HLA-C
  Gene Name: major histocompatibility complex, class I, C
  ENSP ID: ENSP00000403624
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGHFLPTGGKGGSCSQAACSNSAQGSDESLITCKA

SEQ ID NO: 48323 - protein, 372 aa, Homo sapiens
  Payload ID: 9762
  Gene Symbol: HLA-C
  Gene Name: major histocompatibility complex, class I, C
  ENSP ID: ENSP00000404526
MRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVMAVVMCRRKSSGHFLPTGGKGGSCSQAASSNSAQGSDESLIACKA

SEQ ID NO: 48324 - protein, 261 aa, Homo sapiens
  Payload ID: 9762
  Gene Symbol: HLA-C
  Gene Name: major histocompatibility complex, class I, C
  ENSP ID: ENSP00000407051
  MOD_RES (1)..(1): Any amino acid
XRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEASRRWNLPEVGSCGGAFWTRAEIHVPYAARGAARAPHPE

SEQ ID NO: 48325 - protein, 372 aa, Homo sapiens
  Payload ID: 9762
  Gene Symbol: HLA-C
  Gene Name: major histocompatibility complex, class I, C
  ENSP ID: ENSP00000407431
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGHFLPTGGKGGSCSQAASSNSAQGSDESLIACKA

SEQ ID NO: 48326 - protein, 261 aa, Homo sapiens
  Payload ID: 9762
  Gene Symbol: HLA-C
  Gene Name: major histocompatibility complex, class I, C
  ENSP ID: ENSP00000407494
  MOD_RES (1)..(1): Any amino acid
XRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAGSHTLQWMYGCDLGPDGRLLRGYDQSAYDGKDYIALNEDLRSWTAADTAAQITQRKWEAARAAEQQRAYLEGTCVEWLRRYLENGKETLQRAEHPKTHVTHHLVSDHEASRRWNLPEVGSCGGAFWRRAEIHVPCAARGAAGAPHPE

SEQ ID NO: 48327 - protein, 366 aa, Homo sapiens
  Payload ID: 9762
  Gene Symbol: HLA-C
  Gene Name: major histocompatibility complex, class I, C
  Uniprot ID: P30501
  ENSP ID: ENSP00000410214
MRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVMAVVMCRRKSSGGKGGSCSQAASSNSAQGSDESLIACKA

SEQ ID NO: 48328 - protein, 261 aa, Homo sapiens
  Payload ID: 9762
  Gene Symbol: HLA-C
  Gene Name: major histocompatibility complex, class I, C
  ENSP ID: ENSP00000410661
  MOD_RES (1)..(1): Any amino acid
XRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAEHPKTHVTHHPVSDHEASRRWNLPEVGSCGGAFWRRAEIHVPCAARGAARAPHPE

SEQ ID NO: 48329 - protein, 261 aa, Homo sapiens; identical to SEQ ID NO: 48328
  Payload ID: 9762
  Gene Symbol: HLA-C
  Gene Name: major histocompatibility complex, class I, C
  ENSP ID: ENSP00000411867
  MOD_RES (1)..(1): Any amino acid

SEQ ID NO: 48330 - protein, 261 aa, Homo sapiens
  Payload ID: 9762
  Gene Symbol: HLA-C
  Gene Name: major histocompatibility complex, class I, C
  ENSP ID: ENSP00000412426
  MOD_RES (1)..(1): Any amino acid
XRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEASRRWNLPEVGSCGGAFWRRAEIHVPCAARGAAGAPHPE

SEQ ID NO: 48331 - protein, 368 aa, Homo sapiens
  Payload ID: 9762
  Gene Symbol: HLA-C
  Gene Name: major histocompatibility complex, class I, C
  ENSP ID: ENSP00000413189
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSAACVGLRCRISSHLSFVTSRASGISFCKGI

SEQ ID NO: 48332 - protein, 397 aa, Homo sapiens
  Payload ID: 9762
  Gene Symbol: HLA-C
  Gene Name: major histocompatibility complex, class I, C
  ENSP ID: ENSP00000413992
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGREGVKSGVWAATVPRALMSLSSLVKPETAACVGLRCRISSHLSFVTSRASGISFCKGV

SEQ ID NO: 48333 - protein, 366 aa, Homo sapiens
  Payload ID: 9762
  Gene Symbol: HLA-C
  Gene Name: major histocompatibility complex, class I, C
  ENSP ID: ENSP00000414063
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 48334 - protein, 355 aa, Homo sapiens
  Payload ID: 9762
  Gene Symbol: HLA-C
  Gene Name: major histocompatibility complex, class I, C
  ENSP ID: ENSP00000415025
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSASNSAQGSDESLIACKA

SEQ ID NO: 48335 - protein, 131 aa, Homo sapiens
  Payload ID: 9762
  Gene Symbol: HLA-C
  Gene Name: major histocompatibility complex, class I, C
  ENSP ID: ENSP00000431141
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAEDVWLRPGARRAPPPRV

SEQ ID NO: 48336 - protein, 131 aa, Homo sapiens
  Payload ID: 9762
  Gene Symbol: HLA-C
  Gene Name: major histocompatibility complex, class I, C
  ENSP ID: ENSP00000431347
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAVDVWLRPGARRAPPPRV

SEQ ID NO: 48337 - protein, 131 aa, Homo sapiens
  Payload ID: 9762
  Gene Symbol: HLA-C
  Gene Name: major histocompatibility complex, class I, C
  ENSP ID: ENSP00000433088
MRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDVDVWLRPGARRAPPPRV

SEQ ID NO: 48338 - protein, 131 aa, Homo sapiens
  Payload ID: 9762
  Gene Symbol: HLA-C
  Gene Name: major histocompatibility complex, class I, C
  ENSP ID: ENSP00000433409
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAEDVWLRRGARRAPPPRV

SEQ ID NO: 48339 - protein, 224 aa, Homo sapiens
  Payload ID: 9762
  Gene Symbol: HLA-C
  Gene Name: major histocompatibility complex, class I, C
  ENSP ID: ENSP00000433897
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAGQDQKSLFLPQRLELSNE

SEQ ID NO: 48340 - protein, 131 aa, Homo sapiens
  Payload ID: 9762
  Gene Symbol: HLA-C
  Gene Name: major histocompatibility complex, class I, C
  ENSP ID: ENSP00000435957
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDEDVWLRPGARRAPPPRV

SEQ ID NO: 48341 - protein, 224 aa, Homo sapiens
  Payload ID: 9762
  Gene Symbol: HLA-C
  Gene Name: major histocompatibility complex, class I, C
  ENSP ID: ENSP00000436842
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAGQDQKSLFLPQRLELSNE

SEQ ID NO: 48342 - protein, 131 aa, Homo sapiens; identical to SEQ ID NO: 48335
  Payload ID: 9762
  Gene Symbol: HLA-C
  Gene Name: major histocompatibility complex, class I, C
  ENSP ID: ENSP00000436915

SEQ ID NO: 48343 - protein, 49 aa, Homo sapiens
  Payload ID: 9762
  Gene Symbol: HLA-C
  Gene Name: major histocompatibility complex, class I, C
  ENSP ID: ENSP00000483304
AVVVPSGQEQRYTCHMQHEGLQEPLTLSWGGKGGSCSQAACSNSAQGSD

SEQ ID NO: 48344 - protein, 49 aa, Homo sapiens
  Payload ID: 9762
  Gene Symbol: HLA-C
  Gene Name: major histocompatibility complex, class I, C
  ENSP ID: ENSP00000484208
AVVVPSGEEQRYTCHVQHEGLPEPLTLRWGGKGGSCSQAASSNSAQGSD

SEQ ID NO: 48345 - protein, 49 aa, Homo sapiens; identical to SEQ ID NO: 48344
  Payload ID: 9762
  Gene Symbol: HLA-C
  Gene Name: major histocompatibility complex, class I, C
  ENSP ID: ENSP00000484270

SEQ ID NO: 48346 - protein, 358 aa, Homo sapiens
  Payload ID: 9763
  Gene Symbol: HLA-E
  Gene Name: major histocompatibility complex, class I, E
  ENSP ID: ENSP00000365817
MVDGTLLLLLSEALALTQTWAGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDGRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 48347 - protein, 358 aa, Homo sapiens [sequence omitted]

SEQ ID NO: 48348 - protein, 358 aa, Homo sapiens [sequence omitted]

SEQ ID NO: 48349 - protein, 358 aa, Homo sapiens [sequence omitted]

SEQ ID NO: 48350 - protein, 358 aa, Homo sapiens; identical to SEQ ID NO: 48346
  Payload ID: 9763
  Gene Symbol: HLA-E
  Gene Name: major histocompatibility complex, class I, E
  ENSP ID: ENSP00000400458

SEQ ID NO: 48351 - protein, 358 aa, Homo sapiens; identical to SEQ ID NO: 48346
  Payload ID: 9763
  Gene Symbol: HLA-E
  Gene Name: major histocompatibility complex, class I, E
  ENSP ID: ENSP00000402694

SEQ ID NO: 48352 - protein, 358 aa, Homo sapiens [sequence omitted]

SEQ ID NO: 48353 - protein, 442 aa, Homo sapiens
  Payload ID: 9764
  Gene Symbol: HLA-F
  Gene Name: major histocompatibility complex, class I, F
  Uniprot ID: P30511
  ENSP ID: ENSP00000259951
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPIVGIVAGLVVLGAVVTGAVVAAVMWRKKSSDRNRGSYSQAAAYSVVSGNLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 48354 - protein, 346 aa, Homo sapiens
  Payload ID: 9764
  Gene Symbol: HLA-F
  Gene Name: major histocompatibility complex, class I, F
  Uniprot ID: P30511
  ENSP ID: ENSP00000334263
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPIVGIVAGLVVLGAVVTGAVVAAVMWRKKSSDRNRGSYSQAAV

SEQ ID NO: 48355 - protein, 346 aa, Homo sapiens
  Payload ID: 9764
  Gene Symbol: HLA-F
  Gene Name: major histocompatibility complex, class I, F
  ENSP ID: ENSP00000345828
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAV

SEQ ID NO: 48356 - protein, 254 aa, Homo sapiens
  Payload ID: 9764
  Gene Symbol: HLA-F
  Gene Name: major histocompatibility complex, class I, F
  Uniprot ID: P30511
  ENSP ID: ENSP00000351977
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRAEQSPQPTIPIVGIVAGLVVLGAVVTGAVVAAVMWRKKSSDRNRGSYSQAAV

SEQ ID NO: 48357 - protein, 334 aa, Homo sapiens
  Payload ID: 9764
  Gene Symbol: HLA-F
  Gene Name: major histocompatibility complex, class I, F
  ENSP ID: ENSP00000366040
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSS

SEQ ID NO: 48358 - protein, 254 aa, Homo sapiens; identical to SEQ ID NO: 48356
  Payload ID: 9764
  Gene Symbol: HLA-F
  Gene Name: major histocompatibility complex, class I, F
  Uniprot ID: P30511
  ENSP ID: ENSP00000366044

SEQ ID NO: 48359 - protein, 346 aa, Homo sapiens; identical to SEQ ID NO: 48354
  Payload ID: 9764
  Gene Symbol: HLA-F
  Gene Name: major histocompatibility complex, class I, F
  Uniprot ID: P30511
  ENSP ID: ENSP00000366057

SEQ ID NO: 48360 - protein, 254 aa, Homo sapiens; identical to SEQ ID NO: 48356
  Payload ID: 9764
  Gene Symbol: HLA-F
  Gene Name: major histocompatibility complex, class I, F
  Uniprot ID: P30511
  ENSP ID: ENSP00000373007

SEQ ID NO: 48361 - protein, 442 aa, Homo sapiens
  Payload ID: 9764
  Gene Symbol: HLA-F
  Gene Name: major histocompatibility complex, class I, F
  ENSP ID: ENSP00000373008
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAAYSVVSGNLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 48362 - protein, 346 aa, Homo sapiens; identical to SEQ ID NO: 48355
  Payload ID: 9764
  Gene Symbol: HLA-F
  Gene Name: major histocompatibility complex, class I, F
  ENSP ID: ENSP00000373121

SEQ ID NO: 48363 - protein, 442 aa, Homo sapiens; identical to SEQ ID NO: 48361
  Payload ID: 9764
  Gene Symbol: HLA-F
  Gene Name: major histocompatibility complex, class I, F
  ENSP ID: ENSP00000373123

SEQ ID NO: 48364 - protein, 442 aa, Homo sapiens; identical to SEQ ID NO: 48361
  Payload ID: 9764
  Gene Symbol: HLA-F
  Gene Name: major histocompatibility complex, class I, F
  ENSP ID: ENSP00000387786

SEQ ID NO: 48365 - protein, 131 aa, Homo sapiens
  Payload ID: 9764
  Gene Symbol: HLA-F
  Gene Name: major histocompatibility complex, class I, F
  ENSP ID: ENSP00000388133
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLL

SEQ ID NO: 48366 - protein, 131 aa, Homo sapiens; identical to SEQ ID NO: 48365
  Payload ID: 9764
  Gene Symbol: HLA-F
  Gene Name: major histocompatibility complex, class I, F
  ENSP ID: ENSP00000389555

SEQ ID NO: 48367 - protein, 225 aa, Homo sapiens
  Payload ID: 9764
  Gene Symbol: HLA-F
  Gene Name: major histocompatibility complex, class I, F
  ENSP ID: ENSP00000390887
  MOD_RES (1)..(1): Any amino acid
XPDPPPGRVPGAFTQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAV

SEQ ID NO: 48368 - protein, 124 aa, Homo sapiens
  Payload ID: 9764
  Gene Symbol: HLA-F
  Gene Name: major histocompatibility complex, class I, F
  ENSP ID: ENSP00000392251
  MOD_RES (1)..(1): Any amino acid
XAVMWRKKSSGHFLPIDRNRGSYSQAAAYSVVSGNLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 48369 - protein, 254 aa, Homo sapiens; identical to SEQ ID NO: 48356
  Payload ID: 9764
  Gene Symbol: HLA-F
  Gene Name: major histocompatibility complex, class I, F
  Uniprot ID: P30511
  ENSP ID: ENSP00000393535

SEQ ID NO: 48370 - protein, 346 aa, Homo sapiens; identical to SEQ ID NO: 48355
  Payload ID: 9764
  Gene Symbol: HLA-F
  Gene Name: major histocompatibility complex, class I, F
  ENSP ID: ENSP00000395853

SEQ ID NO: 48371 - protein, 131 aa, Homo sapiens; identical to SEQ ID NO: 48365
  Payload ID: 9764
  Gene Symbol: HLA-F
  Gene Name: major histocompatibility complex, class I, F
  ENSP ID: ENSP00000396776

SEQ ID NO: 48372 - protein, 254 aa, Homo sapiens; identical to SEQ ID NO: 48356
  Payload ID: 9764
  Gene Symbol: HLA-F
  Gene Name: major histocompatibility complex, class I, F
  Uniprot ID: P30511
  ENSP ID: ENSP00000397376

SEQ ID NO: 48373 - protein, 442 aa, Homo sapiens
  Payload ID: 9764
  Gene Symbol: HLA-F
  Gene Name: major histocompatibility complex, class I, F
  ENSP ID: ENSP00000397705
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAAYSVVSGLLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 48374 - protein, 225 aa, Homo sapiens
  Payload ID: 9764
  Gene Symbol: HLA-F
  Gene Name: major histocompatibility complex, class I, F
  ENSP ID: ENSP00000398913
  MOD_RES (1)..(1): Any amino acid
XPDPPPGRVPGAFTEHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAV

SEQ ID NO: 48375 - protein, 124 aa, Homo sapiens; identical to SEQ ID NO: 48368
  Payload ID: 9764
  Gene Symbol: HLA-F
  Gene Name: major histocompatibility complex, class I, F
  ENSP ID: ENSP00000399043
  MOD_RES (1)..(1): Any amino acid

SEQ ID NO: 48376 - protein, 124 aa, Homo sapiens
  Payload ID: 9764
  Gene Symbol: HLA-F
  Gene Name: major histocompatibility complex, class I, F
  ENSP ID: ENSP00000399120
  MOD_RES (1)..(1): Any amino acid
XAVMWRKKSSGHFLPIDRNRGSYSQAAAYSVVSGLLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 48377 - protein, 254 aa, Homo sapiens; identical to SEQ ID NO: 48356
  Payload ID: 9764
  Gene Symbol: HLA-F
  Gene Name: major histocompatibility complex, class I, F
  Uniprot ID: P30511
  ENSP ID: ENSP00000399835

SEQ ID NO: 48378 - protein, 225 aa, Homo sapiens; identical to SEQ ID NO: 48374
  Payload ID: 9764
  Gene Symbol: HLA-F
  Gene Name: major histocompatibility complex, class I, F
  ENSP ID: ENSP00000400112
  MOD_RES (1)..(1): Any amino acid

SEQ ID NO: 48379 - protein, 10 aa, Homo sapiens
  Payload ID: 9764
  Gene Symbol: HLA-F
  Gene Name: major histocompatibility complex, class I, F
  ENSP ID: ENSP00000400299
  MOD_RES (1)..(1): Any amino acid
XAVMWRKKSS

SEQ ID NO: 48380 - protein, 346 aa, Homo sapiens; identical to SEQ ID NO: 48355
  Payload ID: 9764
  Gene Symbol: HLA-F
  Gene Name: major histocompatibility complex, class I, F
  ENSP ID: ENSP00000402853

SEQ ID NO: 48381 - protein, 124 aa, Homo sapiens; identical to SEQ ID NO: 48368
  Payload ID: 9764
  Gene Symbol: HLA-F
  Gene Name: major histocompatibility complex, class I, F
  ENSP ID: ENSP00000404395
  MOD_RES (1)..(1): Any amino acid

SEQ ID NO: 48382 - protein, 131 aa, Homo sapiens; identical to SEQ ID NO: 48365
  Payload ID: 9764
  Gene Symbol: HLA-F
  Gene Name: major histocompatibility complex, class I, F
  ENSP ID: ENSP00000405190

SEQ ID NO: 48383 - protein, 242 aa, Homo sapiens
  Payload ID: 9764
  Gene Symbol: HLA-F
  Gene Name: major histocompatibility complex, class I, F
  ENSP ID: ENSP00000405198
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRAEQSPQPTIPIVGIVAGLVVLGAVVTGAVVAAVMWRKKSS

SEQ ID NO: 48384 - protein, 131 aa, Homo sapiens; identical to SEQ ID NO: 48365
  Payload ID: 9764
  Gene Symbol: HLA-F
  Gene Name: major histocompatibility complex, class I, F
  ENSP ID: ENSP00000407836

SEQ ID NO: 48385 - protein, 346 aa, Homo sapiens; identical to SEQ ID NO: 48355
  Payload ID: 9764
  Gene Symbol: HLA-F
  Gene Name: major histocompatibility complex, class I, F
  ENSP ID: ENSP00000408540

SEQ ID NO: 48386 - protein, 131 aa, Homo sapiens; identical to SEQ ID NO: 48365
  Payload ID: 9764
  Gene Symbol: HLA-F
  Gene Name: major histocompatibility complex, class I, F
  ENSP ID: ENSP00000409934

SEQ ID NO: 48387 - protein, 124 aa, Homo sapiens; identical to SEQ ID NO: 48368
  Payload ID: 9764
  Gene Symbol: HLA-F
  Gene Name: major histocompatibility complex, class I, F
  ENSP ID: ENSP00000412140
  MOD_RES (1)..(1): Any amino acid

SEQ ID NO: 48388 - protein, 334 aa, Homo sapiens; identical to SEQ ID NO: 48357
  Payload ID: 9764
  Gene Symbol: HLA-F
  Gene Name: major histocompatibility complex, class I, F
  ENSP ID: ENSP00000414318

SEQ ID NO: 48389 - protein, 225 aa, Homo sapiens; identical to SEQ ID NO: 48367
  Payload ID: 9764
  Gene Symbol: HLA-F
  Gene Name: major histocompatibility complex, class I, F
  ENSP ID: ENSP00000414500
  MOD_RES (1)..(1): Any amino acid

SEQ ID NO: 48390 - protein, 442 aa, Homo sapiens; identical to SEQ ID NO: 48361
  Payload ID: 9764
  Gene Symbol: HLA-F
  Gene Name: major histocompatibility complex, class I, F
  ENSP ID: ENSP00000414905

SEQ ID NO: 48391 - protein, 124 aa, Homo sapiens; identical to SEQ ID NO: 48368
  Payload ID: 9764
  Gene Symbol: HLA-F
  Gene Name: major histocompatibility complex, class I, F
  ENSP ID: ENSP00000415017
  MOD_RES (1)..(1): Any amino acid

SEQ ID NO: 48392 - protein, 225 aa, Homo sapiens; identical to SEQ ID NO: 48374
  Payload ID: 9764
  Gene Symbol: HLA-F
  Gene Name: major histocompatibility complex, class I, F
  ENSP ID: ENSP00000415401
  MOD_RES (1)..(1): Any amino acid

SEQ ID NO: 48393 - protein, 213 aa, Homo sapiens
  Payload ID: 9764
  Gene Symbol: HLA-F
  Gene Name: major histocompatibility complex, class I, F
  ENSP ID: ENSP00000416426
  MOD_RES (1)..(1): Any amino acid
XPDPPPGRVPGAFTEHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSS

SEQ ID NO: 48394 - protein, 346 aa, Homo sapiens; identical to SEQ ID NO: 48355
  Payload ID: 9764
  Gene Symbol: HLA-F
  Gene Name: major histocompatibility complex, class I, F
  ENSP ID: ENSP00000447228

SEQ ID NO: 48395 - protein, 346 aa, Homo sapiens; identical to SEQ ID NO: 48355
  Payload ID: 9764
  Gene Symbol: HLA-F
  Gene Name: major histocompatibility complex, class I, F
  ENSP ID: ENSP00000447401

SEQ ID NO: 48396 - protein, 346 aa, Homo sapiens; identical to SEQ ID NO: 48355
  Payload ID: 9764
  Gene Symbol: HLA-F
  Gene Name: major histocompatibility complex, class I, F
  ENSP ID: ENSP00000448260

SEQ ID NO: 48397 - protein, 346 aa, Homo sapiens; identical to SEQ ID NO: 48355
  Payload ID: 9764
  Gene Symbol: HLA-F
  Gene Name: major histocompatibility complex, class I, F
  ENSP ID: ENSP00000450119

SEQ ID NO: 48398 - protein, 346 aa, Homo sapiens; identical to SEQ ID NO: 48355
  Payload ID: 9764
  Gene Symbol: HLA-F
  Gene Name: major histocompatibility complex, class I, F
  ENSP ID: ENSP00000450300

SEQ ID NO: 48399 - protein, 339 aa, Homo sapiens
  Payload ID: 9764
  Gene Symbol: HLA-F
  Gene Name: major histocompatibility complex, class I, F
  ENSP ID: ENSP00000481264
GSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGVAVITVAVVAAVMWRNKIPGRKGVSSEFPSSRNSTQGSDVSLKA

SEQ ID NO: 48400 - protein, 254 aa, Homo sapiens
  Payload ID: 9764
  Gene Symbol: HLA-F
  Gene Name: major histocompatibility complex, class I, F
  ENSP ID: ENSP00000482177
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRAEQSPQPTIPIVGIVAGLVVLGAVVTGAVVAAVMWRKKSSGRKGSHKSQGKV

SEQ ID NO: 48401 - protein, 346 aa, Homo sapiens
  Payload ID: 9764
  Gene Symbol: HLA-F
  Gene Name: major histocompatibility complex, class I, F
  ENSP ID: ENSP00000483269
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSGRKGSHKSQGKV

SEQ ID NO: 48402 - protein, 72 aa, Homo sapiens
  Payload ID: 9764
  Gene Symbol: HLA-F
  Gene Name: major histocompatibility complex, class I, F
  ENSP ID: ENSP00000486309
  MOD_RES (1)..(1): Any amino acid
XPQPTIPIVGIVAGLVVLGAVVTGAVVAAVMWRKKSSGPAPECLYLSNKYSHPGAIFPPEDISYVWKNVLLP

SEQ ID NO: 48403 - protein, 143 aa, Homo sapiens
  Payload ID: 9764
  Gene Symbol: HLA-F
  Gene Name: major histocompatibility complex, class I, F
  ENSP ID: ENSP00000486947
HHPISDHEATLRCWALGFYPAEITLTWQRDGEEQTQDTELVETRPAGDGTFQKWAAVVVPPGEEQRYTCHVQHEGLPQPLILRWEQSPQPTIPIVGIVAGLVVLGAVVTGAVVAAVMWRKKSSDRNRGSYSQAAGKLTHTGVQ

SEQ ID NO: 48404 - protein, 338 aa, Homo sapiens
  Payload ID: 9765
  Gene Symbol: HLA-G
  Gene Name: major histocompatibility complex, class I, G
  Uniprot ID: P17693
  ENSP ID: ENSP00000353472
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 48405 - protein, 154 aa, Homo sapiens
  Payload ID: 9765
  Gene Symbol: HLA-G
  Gene Name: major histocompatibility complex, class I, G
  ENSP ID: ENSP00000366011
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEAKQSSLPTIPIMGIVAGLVVLAAVVTGAAVAAVLWRKKSSD

SEQ ID NO: 48406 - protein, 246 aa, Homo sapiens
  Payload ID: 9765
  Gene Symbol: HLA-G
  Gene Name: major histocompatibility complex, class I, G
  ENSP ID: ENSP00000366014
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEANPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 48407 - protein, 343 aa, Homo sapiens
  Payload ID: 9765
  Gene Symbol: HLA-G
  Gene Name: major histocompatibility complex, class I, G
  ENSP ID: ENSP00000366024
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 48408 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000373116

SEQ ID NO: 48409 - protein, 154 aa, Homo sapiens; identical to SEQ ID NO: 48405
  Payload ID: 9765
  Gene Symbol: HLA-G
  Gene Name: major histocompatibility complex, class I, G
  ENSP ID: ENSP00000373117

SEQ ID NO: 48410 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000373118

SEQ ID NO: 48411 - protein, 343 aa, Homo sapiens; identical to SEQ ID NO: 48407
  Payload ID: 9765
  Gene Symbol: HLA-G
  Gene Name: major histocompatibility complex, class I, G
  ENSP ID: ENSP00000383506

SEQ ID NO: 48412 - protein, 343 aa, Homo sapiens; identical to SEQ ID NO: 48407
  Payload ID: 9765
  Gene Symbol: HLA-G
  Gene Name: major histocompatibility complex, class I, G
  ENSP ID: ENSP00000383521

SEQ ID NO: 48413 - protein, 343 aa, Homo sapiens; identical to SEQ ID NO: 48407
  Payload ID: 9765
  Gene Symbol: HLA-G
  Gene Name: major histocompatibility complex, class I, G
  ENSP ID: ENSP00000387624

SEQ ID NO: 48414 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000388176

SEQ ID NO: 48415 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000389522

SEQ ID NO: 48416 - protein, 154 aa, Homo sapiens; identical to SEQ ID NO: 48405
  Payload ID: 9765
  Gene Symbol: HLA-G
  Gene Name: major histocompatibility complex, class I, G
  ENSP ID: ENSP00000389969

SEQ ID NO: 48417 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000390678

SEQ ID NO: 48418 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000392075

SEQ ID NO: 48419 - protein, 343 aa, Homo sapiens; identical to SEQ ID NO: 48407
  Payload ID: 9765
  Gene Symbol: HLA-G
  Gene Name: major histocompatibility complex, class I, G
  ENSP ID: ENSP00000392347

SEQ ID NO: 48420 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000396594

SEQ ID NO: 48421 - protein, 343 aa, Homo sapiens; identical to SEQ ID NO: 48407
  Payload ID: 9765
  Gene Symbol: HLA-G
  Gene Name: major histocompatibility complex, class I, G
  ENSP ID: ENSP00000397331

SEQ ID NO: 48422 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000397733

SEQ ID NO: 48423 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000398200

SEQ ID NO: 48424 - protein, 154 aa, Homo sapiens; identical to SEQ ID NO: 48405
  Payload ID: 9765
  Gene Symbol: HLA-G
  Gene Name: major histocompatibility complex, class I, G
  ENSP ID: ENSP00000401326

SEQ ID NO: 48425 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000405238

SEQ ID NO: 48426 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000408461

SEQ ID NO: 48427 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000408773

SEQ ID NO: 48428 - protein, 343 aa, Homo sapiens; identical to SEQ ID NO: 48407
  Payload ID: 9765
  Gene Symbol: HLA-G
  Gene Name: major histocompatibility complex, class I, G
  ENSP ID: ENSP00000409132

SEQ ID NO: 48429 - protein, 154 aa, Homo sapiens; identical to SEQ ID NO: 48405
  Payload ID: 9765
  Gene Symbol: HLA-G
  Gene Name: major histocompatibility complex, class I, G
  ENSP ID: ENSP00000410247

SEQ ID NO: 48430 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000412927

SEQ ID NO: 48431 - protein, 154 aa, Homo sapiens; identical to SEQ ID NO: 48405
  Payload ID: 9765
  Gene Symbol: HLA-G
  Gene Name: major histocompatibility complex, class I, G
  ENSP ID: ENSP00000413926

SEQ ID NO: 48432 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000415905

SEQ ID NO: 48433 - protein, 154 aa, Homo sapiens; identical to SEQ ID NO: 48405
  Payload ID: 9765
  Gene Symbol: HLA-G
  Gene Name: major histocompatibility complex, class I, G
  ENSP ID: ENSP00000416408

SEQ ID NO: 48434 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000432220

SEQ ID NO: 48435 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000432239

SEQ ID NO: 48436 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000433426

SEQ ID NO: 48437 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000434622

SEQ ID NO: 48438 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000436375

SEQ ID NO: 48439 - protein, 246 aa, Homo sapiens; identical to SEQ ID NO: 48406
  Payload ID: 9765
  Gene Symbol: HLA-G
  Gene Name: major histocompatibility complex, class I, G
  ENSP ID: ENSP00000437036

SEQ ID NO: 48440 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000447762

SEQ ID NO: 48441 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000447780

SEQ ID NO: 48442 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000448085

SEQ ID NO: 48443 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000448363

SEQ ID NO: 48444 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000449291

SEQ ID NO: 48445 - protein, 338 aa, Homo sapiens; identical to SEQ ID NO: 48404
  Payload ID: 9765
  Gene Symbol: HLA-G
  Gene Name: major histocompatibility complex, class I, G
  Uniprot ID: P17693
  ENSP ID: ENSP00000449903

SEQ ID NO: 48446 - protein, 246 aa, Homo sapiens
  Payload ID: 9765
  Gene Symbol: HLA-G
  Gene Name: major histocompatibility complex, class I, G
  ENSP ID: ENSP00000479043
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEANPPKTHVTHHPVFDYEATLRCWALGFYPAEIILTWQRDGEDQTQDVELVETRPAGDGTFQKWAAVVVPSGEEQRYMCHVQHEGLPEPLMLRWKQSSLPTIPIMGIVAGLVVLAAVVTGAAVAAVLWRKKSSD

SEQ ID NO: 48447 - protein, 338 aa, Homo sapiens
  Payload ID: 9765
  Gene Symbol: HLA-G
  Gene Name: major histocompatibility complex, class I, G
  ENSP ID: ENSP00000479303
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYMCHVQHEGLPEPLMLRWKQSSLPTIPIMGIVAGLVVLAAVVTGAAVAAVLWRKKSSD

SEQ ID NO: 48448 - protein, 154 aa, Homo sapiens; identical to SEQ ID NO: 48405
  Payload ID: 9765
  Gene Symbol: HLA-G
  Gene Name: major histocompatibility complex, class I, G
  ENSP ID: ENSP00000479399

SEQ ID NO: 48449 - protein, 338 aa, Homo sapiens; identical to SEQ ID NO: 48447
  Payload ID: 9765
  Gene Symbol: HLA-G
  Gene Name: major histocompatibility complex, class I, G
  ENSP ID: ENSP00000482111

SEQ ID NO: 48450 - protein, 246 aa, Homo sapiens; identical to SEQ ID NO: 48446
  Payload ID: 9765
  Gene Symbol: HLA-G
  Gene Name: major histocompatibility complex, class I, G
  ENSP ID: ENSP00000482272

SEQ ID NO: 48451 - protein, 343 aa, Homo sapiens
  Payload ID: 9765
  Gene Symbol: HLA-G
  Gene Name: major histocompatibility complex, class I, G
  ENSP ID: ENSP00000484084
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYMCHVQHEGLPEPLMLRWKQSSLPTIPIMGIVAGLVVLAAVVTGAAVAAVLWRKKSSD

SEQ ID NO: 48452 - protein, 261 aa, Homo sapiens
  Payload ID: 9766
  Gene Symbol: HLA-DMA
  Gene Name: major histocompatibility complex, class II, DM alpha
  Uniprot ID: P28067
  ENSP ID: ENSP00000363976
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 48453 - protein, 227 aa, Homo sapiens
  Payload ID: 9766
  Gene Symbol: HLA-DMA
  Gene Name: major histocompatibility complex, class II, DM alpha
  ENSP ID: ENSP00000372714
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 48454 - protein, 166 aa, Homo sapiens
  Payload ID: 9766
  Gene Symbol: HLA-DMA
  Gene Name: major histocompatibility complex, class II, DM alpha
  ENSP ID: ENSP00000372715
MGHEQNQGAALLQMLPLLWLLPHSWAVPEGFPIAEVFTLKPLEFGKPNTLVCFVSNLFPPMLTVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 48455 - protein, 261 aa, Homo sapiens; identical to SEQ ID NO: 48452
  Payload ID: 9766
  Gene Symbol: HLA-DMA
  Gene Name: major histocompatibility complex, class II, DM alpha
  Uniprot ID: P28067
  ENSP ID: ENSP00000372717

SEQ ID NO: 48456 - protein, 227 aa, Homo sapiens; identical to SEQ ID NO: 48453
  Payload ID: 9766
  Gene Symbol: HLA-DMA
  Gene Name: major histocompatibility complex, class II, DM alpha
  ENSP ID: ENSP00000378714

SEQ ID NO: 48457 - protein, 166 aa, Homo sapiens; identical to SEQ ID NO: 48454
  Payload ID: 9766
  Gene Symbol: HLA-DMA
  Gene Name: major histocompatibility complex, class II, DM alpha
  ENSP ID: ENSP00000378716

SEQ ID NO: 48458 - protein, 227 aa, Homo sapiens; identical to SEQ ID NO: 48453
  Payload ID: 9766
  Gene Symbol: HLA-DMA
  Gene Name: major histocompatibility complex, class II, DM alpha
  ENSP ID: ENSP00000389962

SEQ ID NO: 48459 - protein, 166 aa, Homo sapiens; identical to SEQ ID NO: 48454
  Payload ID: 9766
  Gene Symbol: HLA-DMA
  Gene Name: major histocompatibility complex, class II, DM alpha
  ENSP ID: ENSP00000390001

SEQ ID NO: 48460 - protein, 261 aa, Homo sapiens; identical to SEQ ID NO: 48452
  Payload ID: 9766
  Gene Symbol: HLA-DMA
  Gene Name: major histocompatibility complex, class II, DM alpha
  Uniprot ID: P28067
  ENSP ID: ENSP00000392842

SEQ ID NO: 48461 - protein, 227 aa, Homo sapiens; identical to SEQ ID NO: 48453
  Payload ID: 9766
  Gene Symbol: HLA-DMA
  Gene Name: major histocompatibility complex, class II, DM alpha
  ENSP ID: ENSP00000394366

SEQ ID NO: 48462 - protein, 169 aa, Homo sapiens
  Payload ID: 9766
  Gene Symbol: HLA-DMA
  Gene Name: major histocompatibility complex, class II, DM alpha
  ENSP ID: ENSP00000395056
MWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSVPVEGFGPTFVSAVDGLSFQAFSYLNFTPEPSDIFSC

SEQ ID NO: 48463 - protein, 261 aa, Homo sapiens; identical to SEQ ID NO: 48452
  Payload ID: 9766
  Gene Symbol: HLA-DMA
  Gene Name: major histocompatibility complex, class II, DM alpha
  Uniprot ID: P28067
  ENSP ID: ENSP00000395349

SEQ ID NO: 48464 - protein, 169 aa, Homo sapiens; identical to SEQ ID NO: 48462
  Payload ID: 9766
  Gene Symbol: HLA-DMA
  Gene Name: major histocompatibility complex, class II, DM alpha
  ENSP ID: ENSP00000395579

SEQ ID NO: 48465 - protein, 169 aa, Homo sapiens; identical to SEQ ID NO: 48462
  Payload ID: 9766
  Gene Symbol: HLA-DMA
  Gene Name: major histocompatibility complex, class II, DM alpha
  ENSP ID: ENSP00000398728

SEQ ID NO: 48466 - protein, 227 aa, Homo sapiens; identical to SEQ ID NO: 48453
  Payload ID: 9766
  Gene Symbol: HLA-DMA
  Gene Name: major histocompatibility complex, class II, DM alpha
  ENSP ID: ENSP00000398742

SEQ ID NO: 48467 - protein, 166 aa, Homo sapiens
  Payload ID: 9766
  Gene Symbol: HLA-DMA
  Gene Name: major histocompatibility complex, class II, DM alpha
  ENSP ID: ENSP00000398951
MGHEQNQGAALLQMLPLLWLLPHSWAVPEGFPIAEVFTLKPLEFGKPNTLVCFVSNLFPPMLTVNWQHHSIPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 48468 - protein, 166 aa, Homo sapiens; identical to SEQ ID NO: 48454
  Payload ID: 9766
  Gene Symbol: HLA-DMA
  Gene Name: major histocompatibility complex, class II, DM alpha
  ENSP ID: ENSP00000399032

SEQ ID NO: 48469 - protein, 169 aa, Homo sapiens; identical to SEQ ID NO: 48462
  Payload ID: 9766
  Gene Symbol: HLA-DMA
  Gene Name: major histocompatibility complex, class II, DM alpha
  ENSP ID: ENSP00000399386

SEQ ID NO: 48470 - protein, 169 aa, Homo sapiens
  Payload ID: 9766
  Gene Symbol: HLA-DMA
  Gene Name: major histocompatibility complex, class II, DM alpha
  ENSP ID: ENSP00000400783
MWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSIPVEGFGPTFVSAVDGLSFQAFSYLNFTPEPSDIFSC

SEQ ID NO: 48471 - protein, 227 aa, Homo sapiens
  Payload ID: 9766
  Gene Symbol: HLA-DMA
  Gene Name: major histocompatibility complex, class II, DM alpha
  ENSP ID: ENSP00000402739
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRVNWQHHSIPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 48472 - protein, 169 aa, Homo sapiens; identical to SEQ ID NO: 48462
  Payload ID: 9766
  Gene Symbol: HLA-DMA
  Gene Name: major histocompatibility complex, class II, DM alpha
  ENSP ID: ENSP00000403122

SEQ ID NO: 48473 - protein, 261 aa, Homo sapiens
  Payload ID: 9766
  Gene Symbol: HLA-DMA
  Gene Name: major histocompatibility complex, class II, DM alpha
  ENSP ID: ENSP00000403906
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSIPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 48474 - protein, 261 aa, Homo sapiens; identical to SEQ ID NO: 48452
  Payload ID: 9766
  Gene Symbol: HLA-DMA
  Gene Name: major histocompatibility complex, class II, DM alpha
  Uniprot ID: P28067
  ENSP ID: ENSP00000404018

SEQ ID NO: 48475 - protein, 166 aa, Homo sapiens; identical to SEQ ID NO: 48454
  Payload ID: 9766
  Gene Symbol: HLA-DMA
  Gene Name: major histocompatibility complex, class II, DM alpha
  ENSP ID: ENSP00000405208

SEQ ID NO: 48476 - protein, 290 aa, Homo sapiens
  Payload ID: 9766
  Gene Symbol: HLA-DMA
  Gene Name: major histocompatibility complex, class II, DM alpha
  ENSP ID: ENSP00000405637
VSCWLSDSCQELQRRGIILCSYGVTSPIAVFGRPGRLRNRRHFERRLVPMKWLKKCLDTAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSG

SEQ ID NO: 48477 - protein, 261 aa, Homo sapiens; identical to SEQ ID NO: 48452
  Payload ID: 9766
  Gene Symbol: HLA-DMA
  Gene Name: major histocompatibility complex, class II, DM alpha
  Uniprot ID: P28067
  ENSP ID: ENSP00000407198

SEQ ID NO: 48478 - protein, 169 aa, Homo sapiens; identical to SEQ ID NO: 48462
  Payload ID: 9766
  Gene Symbol: HLA-DMA
  Gene Name: major histocompatibility complex, class II, DM alpha
  ENSP ID: ENSP00000407671

SEQ ID NO: 48479 - protein, 169 aa, Homo sapiens; identical to SEQ ID NO: 48462
  Payload ID: 9766
  Gene Symbol: HLA-DMA
  Gene Name: major histocompatibility complex, class II, DM alpha
  ENSP ID: ENSP00000408141

SEQ ID NO: 48480 - protein, 290 aa, Homo sapiens
  Payload ID: 9766
  Gene Symbol: HLA-DMA
  Gene Name: major histocompatibility complex, class II, DM alpha
  ENSP ID: ENSP00000408520
VSCWLSDSCQELQRRGIILCSYGVTSPIAVFGRPGRLRNRRHFERRLVPMKWLKKCLDTAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSIPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSG

SEQ ID NO: 48481 - protein, 290 aa, Homo sapiens; identical to SEQ ID NO: 48476
  Payload ID: 9766
  Gene Symbol: HLA-DMA
  Gene Name: major histocompatibility complex, class II, DM alpha
  ENSP ID: ENSP00000409144

SEQ ID NO: 48482 - protein, 290 aa, Homo sapiens; identical to SEQ ID NO: 48476
  Payload ID: 9766
  Gene Symbol: HLA-DMA
  Gene Name: major histocompatibility complex, class II, DM alpha
  ENSP ID: ENSP00000409668

SEQ ID NO: 48483 - protein, 166 aa, Homo sapiens; identical to SEQ ID NO: 48454
  Payload ID: 9766
  Gene Symbol: HLA-DMA
  Gene Name: major histocompatibility complex, class II, DM alpha
  ENSP ID: ENSP00000409734

SEQ ID NO: 48484 - protein, 261 aa, Homo sapiens; identical to SEQ ID NO: 48452
  Payload ID: 9766
  Gene Symbol: HLA-DMA
  Gene Name: major histocompatibility complex, class II, DM alpha
  Uniprot ID: P28067
  ENSP ID: ENSP00000410591

SEQ ID NO: 48485 - protein, 290 aa, Homo sapiens; identical to SEQ ID NO: 48476
  Payload ID: 9766
  Gene Symbol: HLA-DMA
  Gene Name: major histocompatibility complex, class II, DM alpha
  ENSP ID: ENSP00000411774

SEQ ID NO: 48486 - protein, 227 aa, Homo sapiens; identical to SEQ ID NO: 48453
  Payload ID: 9766
  Gene Symbol: HLA-DMA
  Gene Name: major histocompatibility complex, class II, DM alpha
  ENSP ID: ENSP00000412100

SEQ ID NO: 48487 - protein, 241 aa, Homo sapiens
  Payload ID: 9766
  Gene Symbol: HLA-DMA
  Gene Name: major histocompatibility complex, class II, DM alpha
  ENSP ID: ENSP00000412550
MKWLKKCLDTAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSG

SEQ ID NO: 48488 - protein, 227 aa, Homo sapiens; identical to SEQ ID NO: 48453
  Payload ID: 9766
  Gene Symbol: HLA-DMA
  Gene Name: major histocompatibility complex, class II, DM alpha
  ENSP ID: ENSP00000414016

SEQ ID NO: 48489 - protein, 290 aa, Homo sapiens; identical to SEQ ID NO: 48476
  Payload ID: 9766
  Gene Symbol: HLA-DMA
  Gene Name: major histocompatibility complex, class II, DM alpha
  ENSP ID: ENSP00000414631

SEQ ID NO: 48490 - protein, 166 aa, Homo sapiens; identical to SEQ ID NO: 48454
  Payload ID: 9766
  Gene Symbol: HLA-DMA
  Gene Name: major histocompatibility complex, class II, DM alpha
  ENSP ID: ENSP00000414945

SEQ ID NO: 48491 - protein, 290 aa, Homo sapiens; identical to SEQ ID NO: 48476
  Payload ID: 9766
  Gene Symbol: HLA-DMA
  Gene Name: major histocompatibility complex, class II, DM alpha
  ENSP ID: ENSP00000415844

SEQ ID NO: 48492 - protein, 263 aa, Homo sapiens
  Payload ID: 9767
  Gene Symbol: HLA-DMB
  Gene Name: major histocompatibility complex, class II, DM beta
  Uniprot ID: P28068
  ENSP ID: ENSP00000372718
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSYTPLPGSNYSEGWHIS

SEQ ID NO: 48493 - protein, 263 aa, Homo sapiens; identical to SEQ ID NO: 48492
  Payload ID: 9767
  Gene Symbol: HLA-DMB
  Gene Name: major histocompatibility complex, class II, DM beta
  Uniprot ID: P28068
  ENSP ID: ENSP00000378723

SEQ ID NO: 48494 - protein, 175 aa, Homo sapiens
  Payload ID: 9767
  Gene Symbol: HLA-DMB
  Gene Name: major histocompatibility complex, class II, DM beta
  ENSP ID: ENSP00000389736
MGHEQNQGAALLQMLPLLWLLPHSWAVPEEQSMITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPA

SEQ ID NO: 48495 - protein, 106 aa, Homo sapiens
  Payload ID: 9767
  Gene Symbol: HLA-DMB
  Gene Name: major histocompatibility complex, class II, DM beta
  ENSP ID: ENSP00000390848
VAKTTPFNTREPVMLACYVWGFYPAEVTITWRKNGKLVMPHSSAHKTAQPNGDWTYQTLSHLALTPSYGDTYTCVVEHTGAPEPILRDWSYTPLPGSNYSEGWHIS

SEQ ID NO: 48496 - protein, 106 aa, Homo sapiens
  Payload ID: 9767
  Gene Symbol: HLA-DMB
  Gene Name: major histocompatibility complex, class II, DM beta
  ENSP ID: ENSP00000391352
VAKTTPFNTREPVMLACYVWGFYPAEVTITWRKNGKLVMPHSSAHKTAQPNGDWTYQTLSHLALTPSYGDTYTCVVEHIGAPEPILRDWSYTPLPGSNYSEGWHIS

SEQ ID NO: 48497 - protein, 106 aa, Homo sapiens; identical to SEQ ID NO: 48495
  Payload ID: 9767
  Gene Symbol: HLA-DMB
  Gene Name: major histocompatibility complex, class II, DM beta
  ENSP ID: ENSP00000391679

SEQ ID NO: 48498 - protein, 141 aa, Homo sapiens
  Payload ID: 9767
  Gene Symbol: HLA-DMB
  Gene Name: major histocompatibility complex, class II, DM beta
  ENSP ID: ENSP00000393285
  MOD_RES (1)..(1): Any amino acid
XTRPPSVQVAKTTPFNTREPVMLACYVWGFYPAEVTITWRKNGKLVMPHSSAHKTAQPNGDWTYQTLSHLALTPSYGDTYTCVVEHTGAPEPILRDWTPGLSPMQTLKVSVSAVTLGLGLIIFSLGVISWRRAGHSRWHIS

SEQ ID NO: 48499 - protein, 263 aa, Homo sapiens; identical to SEQ ID NO: 48492
  Payload ID: 9767
  Gene Symbol: HLA-DMB
  Gene Name: major histocompatibility complex, class II, DM beta
  Uniprot ID: P28068
  ENSP ID: ENSP00000393646

SEQ ID NO: 48500 - protein, 141 aa, Homo sapiens; identical to SEQ ID NO: 48498
  Payload ID: 9767
  Gene Symbol: HLA-DMB
  Gene Name: major histocompatibility complex, class II, DM beta
  ENSP ID: ENSP00000394737
  MOD_RES (1)..(1): Any amino acid

SEQ ID NO: 48501 - protein, 257 aa, Homo sapiens
  Payload ID: 9767
  Gene Symbol: HLA-DMB
  Gene Name: major histocompatibility complex, class II, DM beta
  ENSP ID: ENSP00000394789
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSDLIISLLFIL

SEQ ID NO: 48502 - protein, 257 aa, Homo sapiens
  Payload ID: 9767
  Gene Symbol: HLA-DMB
  Gene Name: major histocompatibility complex, class II, DM beta
  ENSP ID: ENSP00000394997
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHTGAPEPILRDWTPGLSPMQTLKVSVSAVTLGLGLIIFSLGVISWRRAGHSSDLIISLLFIL

SEQ ID NO: 48503 - protein, 257 aa, Homo sapiens; identical to SEQ ID NO: 48501
  Payload ID: 9767
  Gene Symbol: HLA-DMB
  Gene Name: major histocompatibility complex, class II, DM beta
  ENSP ID: ENSP00000396075

SEQ ID NO: 48504 - protein, 141 aa, Homo sapiens
  Payload ID: 9767
  Gene Symbol: HLA-DMB
  Gene Name: major histocompatibility complex, class II, DM beta
  ENSP ID: ENSP00000398332
  MOD_RES (1)..(1): Any amino acid
XTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSRWHIS

SEQ ID NO: 48505 - protein, 175 aa, Homo sapiens; identical to SEQ ID NO: 48494
  Payload ID: 9767
  Gene Symbol: HLA-DMB
  Gene Name: major histocompatibility complex, class II, DM beta
  ENSP ID: ENSP00000398843

SEQ ID NO: 48506 - protein, 263 aa, Homo sapiens
  Payload ID: 9767
  Gene Symbol: HLA-DMB
  Gene Name: major histocompatibility complex, class II, DM beta
  Uniprot ID: P28068
  ENSP ID: ENSP00000398890
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHTGAPEPILRDWTPGLSPMQTLKVSVSAVTLGLGLIIFSLGVISWRRAGHSSYTPLPGSNYSEGWHIS

SEQ ID NO: 48507 - protein, 257 aa, Homo sapiens; identical to SEQ ID NO: 48501
  Payload ID: 9767
  Gene Symbol: HLA-DMB
  Gene Name: major histocompatibility complex, class II, DM beta
  ENSP ID: ENSP00000399130

SEQ ID NO: 48508 - protein, 141 aa, Homo sapiens; identical to SEQ ID NO: 48504
  Payload ID: 9767
  Gene Symbol: HLA-DMB
  Gene Name: major histocompatibility complex, class II, DM beta
  ENSP ID: ENSP00000399634
  MOD_RES (1)..(1): Any amino acid

SEQ ID NO: 48509 - protein, 141 aa, Homo sapiens; identical to SEQ ID NO: 48504
  Payload ID: 9767
  Gene Symbol: HLA-DMB
  Gene Name: major histocompatibility complex, class II, DM beta
  ENSP ID: ENSP00000399759
  MOD_RES (1)..(1): Any amino acid

SEQ ID NO: 48510 - protein, 141 aa, Homo sapiens; identical to SEQ ID NO: 48498
  Payload ID: 9767
  Gene Symbol: HLA-DMB
  Gene Name: major histocompatibility complex, class II, DM beta
  ENSP ID: ENSP00000401238
  MOD_RES (1)..(1): Any amino acid

SEQ ID NO: 48511 - protein, 106 aa, Homo sapiens; identical to SEQ ID NO: 48496
  Payload ID: 9767
  Gene Symbol: HLA-DMB
  Gene Name: major histocompatibility complex, class II, DM beta
  ENSP ID: ENSP00000401587

SEQ ID NO: 48512 - protein, 257 aa, Homo sapiens; identical to SEQ ID NO: 48501
  Payload ID: 9767
  Gene Symbol: HLA-DMB
  Gene Name: major histocompatibility complex, class II, DM beta
  ENSP ID: ENSP00000402800

SEQ ID NO: 48513 - protein, 175 aa, Homo sapiens; identical to SEQ ID NO: 48494
  Payload ID: 9767
  Gene Symbol: HLA-DMB
  Gene Name: major histocompatibility complex, class II, DM beta
  ENSP ID: ENSP00000404072

SEQ ID NO: 48514 - protein, 106 aa, Homo sapiens; identical to SEQ ID NO: 48496
  Payload ID: 9767
  Gene Symbol: HLA-DMB
  Gene Name: major histocompatibility complex, class II, DM beta
  ENSP ID: ENSP00000405746

SEQ ID NO: 48515 - protein, 106 aa, Homo sapiens; identical to SEQ ID NO: 48495
  Payload ID: 9767
  Gene Symbol: HLA-DMB
  Gene Name: major histocompatibility complex, class II, DM beta
  ENSP ID: ENSP00000405790

SEQ ID NO: 48516 - protein, 106 aa, Homo sapiens; identical to SEQ ID NO: 48495
  Payload ID: 9767
  Gene Symbol: HLA-DMB
  Gene Name: major histocompatibility complex, class II, DM beta
  ENSP ID: ENSP00000406776

SEQ ID NO: 48517 - protein, 263 aa, Homo sapiens; identical to SEQ ID NO: 48506
  Payload ID: 9767
  Gene Symbol: HLA-DMB
  Gene Name: major histocompatibility complex, class II, DM beta
  Uniprot ID: P28068
  ENSP ID: ENSP00000408453

SEQ ID NO: 48518 - protein, 141 aa, Homo sapiens; identical to SEQ ID NO: 48504
  Payload ID: 9767
  Gene Symbol: HLA-DMB
  Gene Name: major histocompatibility complex, class II, DM beta
  ENSP ID: ENSP00000410077
  MOD_RES (1)..(1): Any amino acid

SEQ ID NO: 48519 - protein, 175 aa, Homo sapiens; identical to SEQ ID NO: 48494
  Payload ID: 9767
  Gene Symbol: HLA-DMB
  Gene Name: major histocompatibility complex, class II, DM beta
  ENSP ID: ENSP00000410329

SEQ ID NO: 48520 - protein, 106 aa, Homo sapiens; identical to SEQ ID NO: 48496
  Payload ID: 9767
  Gene Symbol: HLA-DMB
  Gene Name: major histocompatibility complex, class II, DM beta
  ENSP ID: ENSP00000410609

SEQ ID NO: 48521 - protein, 175 aa, Homo sapiens; identical to SEQ ID NO: 48494
  Payload ID: 9767
  Gene Symbol: HLA-DMB
  Gene Name: major histocompatibility complex, class II, DM beta
  ENSP ID: ENSP00000410908

SEQ ID NO: 48522 - protein, 141 aa, Homo sapiens; identical to SEQ ID NO: 48498
  Payload ID: 9767
  Gene Symbol: HLA-DMB
  Gene Name: major histocompatibility complex, class II, DM beta
  ENSP ID: ENSP00000411276
  MOD_RES (1)..(1): Any amino acid

SEQ ID NO: 48523 - protein, 263 aa, Homo sapiens; identical to SEQ ID NO: 48492
  Payload ID: 9767
  Gene Symbol: HLA-DMB
  Gene Name: major histocompatibility complex, class II, DM beta
  Uniprot ID: P28068
  ENSP ID: ENSP00000411321

SEQ ID NO: 48524 - protein, 175 aa, Homo sapiens; identical to SEQ ID NO: 48494
  Payload ID: 9767
  Gene Symbol: HLA-DMB
  Gene Name: major histocompatibility complex, class II, DM beta
  ENSP ID: ENSP00000412415

SEQ ID NO: 48525 - protein, 257 aa, Homo sapiens; identical to SEQ ID NO: 48502
  Payload ID: 9767
  Gene Symbol: HLA-DMB
  Gene Name: major histocompatibility complex, class II, DM beta
  ENSP ID: ENSP00000413062

SEQ ID NO: 48526 - protein, 263 aa, Homo sapiens; identical to SEQ ID NO: 48506
  Payload ID: 9767
  Gene Symbol: HLA-DMB
  Gene Name: major histocompatibility complex, class II, DM beta
  Uniprot ID: P28068
  ENSP ID: ENSP00000413471

SEQ ID NO: 48527 - protein, 175 aa, Homo sapiens; identical to SEQ ID NO: 48494
  Payload ID: 9767
  Gene Symbol: HLA-DMB
  Gene Name: major histocompatibility complex, class II, DM beta
  ENSP ID: ENSP00000414153

SEQ ID NO: 48528 - protein, 263 aa, Homo sapiens; identical to SEQ ID NO: 48506
  Payload ID: 9767
  Gene Symbol: HLA-DMB
  Gene Name: major histocompatibility complex, class II, DM beta
  Uniprot ID: P28068
  ENSP ID: ENSP00000414817

SEQ ID NO: 48529 - protein, 257 aa, Homo sapiens; identical to SEQ ID NO: 48502
  Payload ID: 9767
  Gene Symbol: HLA-DMB
  Gene Name: major histocompatibility complex, class II, DM beta
  ENSP ID: ENSP00000416157

SEQ ID NO: 48530 - protein, 250 aa, Homo sapiens
  Payload ID: 9768
  Gene Symbol: HLA-DOA
  Gene Name: major histocompatibility complex, class II, DO alpha
  Uniprot ID: P06340
  ENSP ID: ENSP00000229829
MALRAGLVLGFHTLMTLLSPQEAGATKADHMGSYGPAFYQSYGASGQFTHEFDEEQLFSVDLKKSEAVWRLPEFGDFARFDPQGGLAGIAAIKAHLDILVERSNRSRAINVPPRVTVLPKSRVELGQPNILICIVDNIFPPVINITWLRNGQTVTEGVAQTSFYSQPDHLFRKFHYLPFVPSAEDVYDCQVEHWGLDAPLLRHWELQVPIPPPDAMETLVCALGLAIGLVGFLVGTVLIIMGTYVSSVPR

SEQ ID NO: 48531 - protein, 86 aa, Homo sapiens
  Payload ID: 9768
  Gene Symbol: HLA-DOA
  Gene Name: major histocompatibility complex, class II, DO alpha
  ENSP ID: ENSP00000363946
MALRAGLVLGFHTLMTLLSPQEAGATKGRAGRHRRNQSPSGHPGGALQPQQSHQRASTGDRAPQVSGGAGPAQHPHLHRGQHLPPC

SEQ ID NO: 48532 - protein, 86 aa, Homo sapiens; identical to SEQ ID NO: 48531
  Payload ID: 9768
  Gene Symbol: HLA-DOA
  Gene Name: major histocompatibility complex, class II, DO alpha
  ENSP ID: ENSP00000372712

SEQ ID NO: 48533 - protein, 250 aa, Homo sapiens; identical to SEQ ID NO: 48530
  Payload ID: 9768
  Gene Symbol: HLA-DOA
  Gene Name: major histocompatibility complex, class II, DO alpha
  Uniprot ID: P06340
  ENSP ID: ENSP00000372713

SEQ ID NO: 48534 - protein, 250 aa, Homo sapiens; identical to SEQ ID NO: 48530
  Payload ID: 9768
  Gene Symbol: HLA-DOA
  Gene Name: major histocompatibility complex, class II, DO alpha
  Uniprot ID: P06340
  ENSP ID: ENSP00000395737

SEQ ID NO: 48535 - protein, 250 aa, Homo sapiens; identical to SEQ ID NO: 48530
  Payload ID: 9768
  Gene Symbol: HLA-DOA
  Gene Name: major histocompatibility complex, class II, DO alpha
  Uniprot ID: P06340
  ENSP ID: ENSP00000397945

SEQ ID NO: 48536 - protein, 250 aa, Homo sapiens; identical to SEQ ID NO: 48530
  Payload ID: 9768
  Gene Symbol: HLA-DOA
  Gene Name: major histocompatibility complex, class II, DO alpha
  Uniprot ID: P06340
  ENSP ID: ENSP00000398819

SEQ ID NO: 48537 - protein, 250 aa, Homo sapiens; identical to SEQ ID NO: 48530
  Payload ID: 9768
  Gene Symbol: HLA-DOA
  Gene Name: major histocompatibility complex, class II, DO alpha
  Uniprot ID: P06340
  ENSP ID: ENSP00000401504

SEQ ID NO: 48538 - protein, 86 aa, Homo sapiens
  Payload ID: 9768
  Gene Symbol: HLA-DOA
  Gene Name: major histocompatibility complex, class II, DO alpha
  ENSP ID: ENSP00000402076
MALRAGLVLGFHTLMTLLSPQEAGATKGWAGRHRRNQSPSGHPGGALQPQQSHQRASTGDRAPQVSGGAGPAQHPHLHRGQHLPPC

SEQ ID NO: 48539 - protein, 86 aa, Homo sapiens; identical to SEQ ID NO: 48531
  Payload ID: 9768
  Gene Symbol: HLA-DOA
  Gene Name: major histocompatibility complex, class II, DO alpha
  ENSP ID: ENSP00000402347

SEQ ID NO: 48540 - protein, 86 aa, Homo sapiens; identical to SEQ ID NO: 48538
  Payload ID: 9768
  Gene Symbol: HLA-DOA
  Gene Name: major histocompatibility complex, class II, DO alpha
  ENSP ID: ENSP00000402487

SEQ ID NO: 48541 - protein, 61 aa, Homo sapiens
  Payload ID: 9768
  Gene Symbol: HLA-DOA
  Gene Name: major histocompatibility complex, class II, DO alpha
  ENSP ID: ENSP00000403896
MALRAGLVLGFHTLMTLLSPQEAGATKADHMGSYGPPSTSLTAPRASSPMNLMRNSCSLWT

SEQ ID NO: 48542 - protein, 86 aa, Homo sapiens; identical to SEQ ID NO: 48531
  Payload ID: 9768
  Gene Symbol: HLA-DOA
  Gene Name: major histocompatibility complex, class II, DO alpha
  ENSP ID: ENSP00000405153

SEQ ID NO: 48543 - protein, 86 aa, Homo sapiens; identical to SEQ ID NO: 48531
  Payload ID: 9768
  Gene Symbol: HLA-DOA
  Gene Name: major histocompatibility complex, class II, DO alpha
  ENSP ID: ENSP00000409491

SEQ ID NO: 48544 - protein, 250 aa, Homo sapiens; identical to SEQ ID NO: 48530
  Payload ID: 9768
  Gene Symbol: HLA-DOA
  Gene Name: major histocompatibility complex, class II, DO alpha
  Uniprot ID: P06340
  ENSP ID: ENSP00000416448

SEQ ID NO: 48545 - protein, 61 aa, Homo sapiens; identical to SEQ ID NO: 48541
  Payload ID: 9768
  Gene Symbol: HLA-DOA
  Gene Name: major histocompatibility complex, class II, DO alpha
  ENSP ID: ENSP00000446500

SEQ ID NO: 48546 - protein, 61 aa, Homo sapiens; identical to SEQ ID NO: 48541
  Payload ID: 9768
  Gene Symbol: HLA-DOA
  Gene Name: major histocompatibility complex, class II, DO alpha
  ENSP ID: ENSP00000446715

SEQ ID NO: 48547 - protein, 61 aa, Homo sapiens; identical to SEQ ID NO: 48541
  Payload ID: 9768
  Gene Symbol: HLA-DOA
  Gene Name: major histocompatibility complex, class II, DO alpha
  ENSP ID: ENSP00000447202

SEQ ID NO: 48548 - protein, 61 aa, Homo sapiens; identical to SEQ ID NO: 48541
  Payload ID: 9768
  Gene Symbol: HLA-DOA
  Gene Name: major histocompatibility complex, class II, DO alpha
  ENSP ID: ENSP00000449183

SEQ ID NO: 48549 - protein, 61 aa, Homo sapiens; identical to SEQ ID NO: 48541
  Payload ID: 9768
  Gene Symbol: HLA-DOA
  Gene Name: major histocompatibility complex, class II, DO alpha
  ENSP ID: ENSP00000449395

SEQ ID NO: 48550 - protein, 61 aa, Homo sapiens; identical to SEQ ID NO: 48541
  Payload ID: 9768
  Gene Symbol: HLA-DOA
  Gene Name: major histocompatibility complex, class II, DO alpha
  ENSP ID: ENSP00000449656

SEQ ID NO: 48551 - protein, 273 aa, Homo sapiens
  Payload ID: 9769
  Gene Symbol: HLA-DOB
  Gene Name: major histocompatibility complex, class II, DO beta
  Uniprot ID: P13765
  ENSP ID: ENSP00000390020
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGLIFLLVGIVIQLRAQKGYVRTQMSGNEVSRAVLLPQSC

SEQ ID NO: 48552 - protein, 181 aa, Homo sapiens
  Payload ID: 9769
  Gene Symbol: HLA-DOB
  Gene Name: major histocompatibility complex, class II, DO beta
  ENSP ID: ENSP00000390574
  MOD_RES (1)..(1): Any amino acid
XNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKEVTVYPERTPLLHQHNLLHCSVTGFYPGDIKIKWFLNGQEERAGVMSTGPIRNGDWTFQTVVMLEMTPELGHVY

SEQ ID NO: 48553 - protein, 181 aa, Homo sapiens; identical to SEQ ID NO: 48552
  Payload ID: 9769
  Gene Symbol: HLA-DOB
  Gene Name: major histocompatibility complex, class II, DO beta
  ENSP ID: ENSP00000391708
  MOD_RES (1)..(1): Any amino acid

SEQ ID NO: 48554 - protein, 273 aa, Homo sapiens; identical to SEQ ID NO: 48551
  Payload ID: 9769
  Gene Symbol: HLA-DOB
  Gene Name: major histocompatibility complex, class II, DO beta
  Uniprot ID: P13765
  ENSP ID: ENSP00000394783

SEQ ID NO: 48555 - protein, 181 aa, Homo sapiens; identical to SEQ ID NO: 48552
  Payload ID: 9769
  Gene Symbol: HLA-DOB
  Gene Name: major histocompatibility complex, class II, DO beta
  ENSP ID: ENSP00000394860
  MOD_RES (1)..(1): Any amino acid

SEQ ID NO: 48556 - protein, 273 aa, Homo sapiens; identical to SEQ ID NO: 48551
  Payload ID: 9769
  Gene Symbol: HLA-DOB
  Gene Name: major histocompatibility complex, class II, DO beta
  Uniprot ID: P13765
  ENSP ID: ENSP00000395780

SEQ ID NO: 48557 - protein, 273 aa, Homo sapiens
  Payload ID: 9769
  Gene Symbol: HLA-DOB
  Gene Name: major histocompatibility complex, class II, DO beta
  Uniprot ID: P13765
  ENSP ID: ENSP00000397268
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPISVEWRAQSEYSWRKMLSGIAAFLLGLIFLLVGIVIQLRAQKGYVRTQMSGNEVSRAVLLPQSC

SEQ ID NO: 48558 - protein, 181 aa, Homo sapiens; identical to SEQ ID NO: 48552
  Payload ID: 9769
  Gene Symbol: HLA-DOB
  Gene Name: major histocompatibility complex, class II, DO beta
  ENSP ID: ENSP00000401290
  MOD_RES (1)..(1): Any amino acid

SEQ ID NO: 48559 - protein, 273 aa, Homo sapiens; identical to SEQ ID NO: 48551
  Payload ID: 9769
  Gene Symbol: HLA-DOB
  Gene Name: major histocompatibility complex, class II, DO beta
  Uniprot ID: P13765
  ENSP ID: ENSP00000405108

SEQ ID NO: 48560 - protein, 181 aa, Homo sapiens; identical to SEQ ID NO: 48552
  Payload ID: 9769
  Gene Symbol: HLA-DOB
  Gene Name: major histocompatibility complex, class II, DO beta
  ENSP ID: ENSP00000406128
  MOD_RES (1)..(1): Any amino acid

SEQ ID NO: 48561 - protein, 273 aa, Homo sapiens; identical to SEQ ID NO: 48551
  Payload ID: 9769
  Gene Symbol: HLA-DOB
  Gene Name: major histocompatibility complex, class II, DO beta
  Uniprot ID: P13765
  ENSP ID: ENSP00000410390

SEQ ID NO: 48562 - protein, 181 aa, Homo sapiens; identical to SEQ ID NO: 48552
  Payload ID: 9769
  Gene Symbol: HLA-DOB
  Gene Name: major histocompatibility complex, class II, DO beta
  ENSP ID: ENSP00000413915
  MOD_RES (1)..(1): Any amino acid

SEQ ID NO: 48563 - protein, 244 aa, Homo sapiens
  Payload ID: 9769
  Gene Symbol: HLA-DOB
  Gene Name: major histocompatibility complex, class II, DO beta
  ENSP ID: ENSP00000431178
VSFFSFLQNGFWVGPLGGGSASESDPTGFLHDSRHRLSSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGLIFLLVGIVIQLRAQKGYVRTQMSGNEVSRAVLLPQSC

SEQ ID NO: 48564 - protein, 38 aa, Homo sapiens
  Payload ID: 9769
  Gene Symbol: HLA-DOB
  Gene Name: major histocompatibility complex, class II, DO beta
  ENSP ID: ENSP00000431358
MGSGWVPWVVALLVNLTRLDSSMTQGTDSPVMWGCLWH

SEQ ID NO: 48565 - protein, 38 aa, Homo sapiens; identical to SEQ ID NO: 48564
  Payload ID: 9769
  Gene Symbol: HLA-DOB
  Gene Name: major histocompatibility complex, class II, DO beta
  ENSP ID: ENSP00000431385

SEQ ID NO: 48566 - protein, 38 aa, Homo sapiens; identical to SEQ ID NO: 48564
  Payload ID: 9769
  Gene Symbol: HLA-DOB
  Gene Name: major histocompatibility complex, class II, DO beta
  ENSP ID: ENSP00000433049

SEQ ID NO: 48567 - protein, 38 aa, Homo sapiens; identical to SEQ ID NO: 48564
  Payload ID: 9769
  Gene Symbol: HLA-DOB
  Gene Name: major histocompatibility complex, class II, DO beta
  ENSP ID: ENSP00000434472

SEQ ID NO: 48568 - protein, 38 aa, Homo sapiens; identical to SEQ ID NO: 48564
  Payload ID: 9769
  Gene Symbol: HLA-DOB
  Gene Name: major histocompatibility complex, class II, DO beta
  ENSP ID: ENSP00000436618

SEQ ID NO: 48569 - protein, 154 aa, Homo sapiens
  Payload ID: 9769
  Gene Symbol: HLA-DOB
  Gene Name: major histocompatibility complex, class II, DO beta
  ENSP ID: ENSP00000437213
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKGFYPGDIKIKWFLNGQEERAGVMSTGPIRNGDWT

SEQ ID NO: 48570 - protein, 260 aa, Homo sapiens
  Payload ID: 9770
  Gene Symbol: HLA-DPA1
  Gene Name: major histocompatibility complex, class II, DP alpha 1
  Uniprot ID: P20036
  ENSP ID: ENSP00000363941
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 48571 - protein, 260 aa, Homo sapiens; identical to SEQ ID NO: 48570
  Payload ID: 9770
  Gene Symbol: HLA-DPA1
  Gene Name: major histocompatibility complex, class II, DP alpha 1
  Uniprot ID: P20036
  ENSP ID: ENSP00000372711

SEQ ID NO: 48572 - protein, 212 aa, Homo sapiens
  Payload ID: 9770
  Gene Symbol: HLA-DPA1
  Gene Name: major histocompatibility complex, class II, DP alpha 1
  ENSP ID: ENSP00000387396
MRPEDRMFHIRAVILRALSLAFLLSLRGAGAIKADHVSTYAAFVQTHRPTGEFMFEFDEDEMFYVDLDKKETVWHLEEFGQAFSFEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLII

SEQ ID NO: 48573 - protein, 212 aa, Homo sapiens; identical to SEQ ID NO: 48572
  Payload ID: 9770
  Gene Symbol: HLA-DPA1
  Gene Name: major histocompatibility complex, class II, DP alpha 1
  ENSP ID: ENSP00000387623

SEQ ID NO: 48574 - protein, 209 aa, Homo sapiens
  Payload ID: 9770
  Gene Symbol: HLA-DPA1
  Gene Name: major histocompatibility complex, class II, DP alpha 1
  ENSP ID: ENSP00000388308
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHW

SEQ ID NO: 48575 - protein, 212 aa, Homo sapiens; identical to SEQ ID NO: 48572
  Payload ID: 9770
  Gene Symbol: HLA-DPA1
  Gene Name: major histocompatibility complex, class II, DP alpha 1
  ENSP ID: ENSP00000388488

SEQ ID NO: 48576 - protein, 209 aa, Homo sapiens; identical to SEQ ID NO: 48574
  Payload ID: 9770
  Gene Symbol: HLA-DPA1
  Gene Name: major histocompatibility complex, class II, DP alpha 1
  ENSP ID: ENSP00000390929

SEQ ID NO: 48577 - protein, 23 aa, Homo sapiens
  Payload ID: 9770
  Gene Symbol: HLA-DPA1
  Gene Name: major histocompatibility complex, class II, DP alpha 1
  ENSP ID: ENSP00000391411
MRPEDRMFHIRAVILRALSLAFL

SEQ ID NO: 48578 - protein, 128 aa, Homo sapiens
  Payload ID: 9770
  Gene Symbol: HLA-DPA1
  Gene Name: major histocompatibility complex, class II, DP alpha 1
  ENSP ID: ENSP00000393072
  MOD_RES (1)..(1): Any amino acid
XNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 48579 - protein, 128 aa, Homo sapiens; identical to SEQ ID NO: 48578
  Payload ID: 9770
  Gene Symbol: HLA-DPA1
  Gene Name: major histocompatibility complex, class II, DP alpha 1
  ENSP ID: ENSP00000393305
  MOD_RES (1)..(1): Any amino acid

SEQ ID NO: 48580 - protein, 260 aa, Homo sapiens; identical to SEQ ID NO: 48570
  Payload ID: 9770
  Gene Symbol: HLA-DPA1
  Gene Name: major histocompatibility complex, class II, DP alpha 1
  Uniprot ID: P20036
  ENSP ID: ENSP00000393566

SEQ ID NO: 48581 - protein, 128 aa, Homo sapiens; identical to SEQ ID NO: 48578
  Payload ID: 9770
  Gene Symbol: HLA-DPA1
  Gene Name: major histocompatibility complex, class II, DP alpha 1
  ENSP ID: ENSP00000394292
  MOD_RES (1)..(1): Any amino acid

SEQ ID NO: 48582 - protein, 212 aa, Homo sapiens; identical to SEQ ID NO: 48572
  Payload ID: 9770
  Gene Symbol: HLA-DPA1
  Gene Name: major histocompatibility complex, class II, DP alpha 1
  ENSP ID: ENSP00000395011

SEQ ID NO: 48583 - protein, 23 aa, Homo sapiens
  Payload ID: 9770
  Gene Symbol: HLA-DPA1
  Gene Name: major histocompatibility complex, class II, DP alpha 1
  ENSP ID: ENSP00000395508
MRPEDRMFHIRAVILRALSLAFL

SEQ ID NO: 48584 - protein, 128 aa, Homo sapiens; identical to SEQ ID NO: 48578
  Payload ID: 9770
  Gene Symbol: HLA-DPA1
  Gene Name: major histocompatibility complex, class II, DP alpha 1
  ENSP ID: ENSP00000395677
  MOD_RES (1)..(1): Any amino acid

SEQ ID NO: 48585 - protein, 260 aa, Homo sapiens; identical to SEQ ID NO: 48570
  Payload ID: 9770
  Gene Symbol: HLA-DPA1
  Gene Name: major histocompatibility complex, class II, DP alpha 1
  Uniprot ID: P20036
  ENSP ID: ENSP00000397139

SEQ ID NO: 48586 - protein, 128 aa, Homo sapiens; identical to SEQ ID NO: 48578
  Payload ID: 9770
  Gene Symbol: HLA-DPA1
  Gene Name: major histocompatibility complex, class II, DP alpha 1
  ENSP ID: ENSP00000397509
  MOD_RES (1)..(1): Any amino acid

SEQ ID NO: 48587 - protein, 260 aa, Homo sapiens; identical to SEQ ID NO: 48570
  Payload ID: 9770
  Gene Symbol: HLA-DPA1
  Gene Name: major histocompatibility complex, class II, DP alpha 1
  Uniprot ID: P20036
  ENSP ID: ENSP00000397587

SEQ ID NO: 48588 - protein, 23 aa, Homo sapiens
  Payload ID: 9770
  Gene Symbol: HLA-DPA1
  Gene Name: major histocompatibility complex, class II, DP alpha 1
  ENSP ID: ENSP00000398134
MRPEDRMFHIRAVILRALSLAFL

SEQ ID NO: 48589 - protein, 209 aa, Homo sapiens; identical to SEQ ID NO: 48574
  Payload ID: 9770
  Gene Symbol: HLA-DPA1
  Gene Name: major histocompatibility complex, class II, DP alpha 1
  ENSP ID: ENSP00000400133

SEQ ID NO: 48590 - protein, 209 aa, Homo sapiens; identical to SEQ ID NO: 48574
  Payload ID: 9770
  Gene Symbol: HLA-DPA1
  Gene Name: major histocompatibility complex, class II, DP alpha 1
  ENSP ID: ENSP00000402344

SEQ ID NO: 48591 - protein, 209 aa, Homo sapiens; identical to SEQ ID NO: 48574
  Payload ID: 9770
  Gene Symbol: HLA-DPA1
  Gene Name: major histocompatibility complex, class II, DP alpha 1
  ENSP ID: ENSP00000402683

SEQ ID NO: 48592 - protein, 23 aa, Homo sapiens
  Payload ID: 9770
  Gene Symbol: HLA-DPA1
  Gene Name: major histocompatibility complex, class II, DP alpha 1
  ENSP ID: ENSP00000402975
MRPEDRMFHIRAVILRALSLAFL

SEQ ID NO: 48593 - protein, 128 aa, Homo sapiens; identical to SEQ ID NO: 48578
  Payload ID: 9770
  Gene Symbol: HLA-DPA1
  Gene Name: major histocompatibility complex, class II, DP alpha 1
  ENSP ID: ENSP00000403013
  MOD_RES (1)..(1): Any amino acid

SEQ ID NO: 48594 - protein, 128 aa, Homo sapiens; identical to SEQ ID NO: 48578
  Payload ID: 9770
  Gene Symbol: HLA-DPA1
  Gene Name: major histocompatibility complex, class II, DP alpha 1
  ENSP ID: ENSP00000403185
  MOD_RES (1)..(1): Any amino acid

SEQ ID NO: 48595 - protein, 212 aa, Homo sapiens; identical to SEQ ID NO: 48572
  Payload ID: 9770
  Gene Symbol: HLA-DPA1
  Gene Name: major histocompatibility complex, class II, DP alpha 1
  ENSP ID: ENSP00000404940

SEQ ID NO: 48596 - protein, 128 aa, Homo sapiens; identical to SEQ ID NO: 48578
  Payload ID: 9770
  Gene Symbol: HLA-DPA1
  Gene Name: major histocompatibility complex, class II, DP alpha 1
  ENSP ID: ENSP00000405500
  MOD_RES (1)..(1): Any amino acid

SEQ ID NO: 48597 - protein, 260 aa, Homo sapiens; identical to SEQ ID NO: 48570
  Payload ID: 9770
  Gene Symbol: HLA-DPA1
  Gene Name: major histocompatibility complex, class II, DP alpha 1
  Uniprot ID: P20036
  ENSP ID: ENSP00000405838

SEQ ID NO: 48598 - protein, 260 aa, Homo sapiens; identical to SEQ ID NO: 48570
  Payload ID: 9770
  Gene Symbol: HLA-DPA1
  Gene Name: major histocompatibility complex, class II, DP alpha 1
  Uniprot ID: P20036
  ENSP ID: ENSP00000406250

SEQ ID NO: 48599 - protein, 23 aa, Homo sapiens
  Payload ID: 9770
  Gene Symbol: HLA-DPA1
  Gene Name: major histocompatibility complex, class II, DP alpha 1
  ENSP ID: ENSP00000407795
MRPEDRMFHIRAVILRALSLAFL

SEQ ID NO: 48600 - protein, 23 aa, Homo sapiens
  Payload ID: 9770
  Gene Symbol: HLA-DPA1
  Gene Name: major histocompatibility complex, class II, DP alpha 1
  ENSP ID: ENSP00000408416
MRPEDRMFHIRAVILRALSLAFL

SEQ ID NO: 48601 - protein, 209 aa, Homo sapiens; identical to SEQ ID NO: 48574
  Payload ID: 9770
  Gene Symbol: HLA-DPA1
  Gene Name: major histocompatibility complex, class II, DP alpha 1
  ENSP ID: ENSP00000410935

SEQ ID NO: 48602 - protein, 209 aa, Homo sapiens; identical to SEQ ID NO: 48574
  Payload ID: 9770
  Gene Symbol: HLA-DPA1
  Gene Name: major histocompatibility complex, class II, DP alpha 1
  ENSP ID: ENSP00000413481

SEQ ID NO: 48603 - protein, 212 aa, Homo sapiens; identical to SEQ ID NO: 48572
  Payload ID: 9770
  Gene Symbol: HLA-DPA1
  Gene Name: major histocompatibility complex, class II, DP alpha 1
  ENSP ID: ENSP00000413558

SEQ ID NO: 48604 - protein, 23 aa, Homo sapiens
  Payload ID: 9770
  Gene Symbol: HLA-DPA1
  Gene Name: major histocompatibility complex, class II, DP alpha 1
  ENSP ID: ENSP00000415119
MRPEDRMFHIRAVILRALSLAFL

SEQ ID NO: 48605 - protein, 23 aa, Homo sapiens
  Payload ID: 9770
  Gene Symbol: HLA-DPA1
  Gene Name: major histocompatibility complex, class II, DP alpha 1
  ENSP ID: ENSP00000415693
MRPEDRMFHIRAVILRALSLAFL

SEQ ID NO: 48606 - protein, 212 aa, Homo sapiens; identical to SEQ ID NO: 48572
  Payload ID: 9770
  Gene Symbol: HLA-DPA1
  Gene Name: major histocompatibility complex, class II, DP alpha 1
  ENSP ID: ENSP00000423441

SEQ ID NO: 48607 - protein, 209 aa, Homo sapiens; identical to SEQ ID NO: 48574
  Payload ID: 9770
  Gene Symbol: HLA-DPA1
  Gene Name: major histocompatibility complex, class II, DP alpha 1
  ENSP ID: ENSP00000424190

SEQ ID NO: 48608 - protein, 260 aa, Homo sapiens; identical to SEQ ID NO: 48570
  Payload ID: 9770
  Gene Symbol: HLA-DPA1
  Gene Name: major histocompatibility complex, class II, DP alpha 1
  Uniprot ID: P20036
  ENSP ID: ENSP00000427429

SEQ ID NO: 48609 - protein, 260 aa, Homo sapiens; identical to SEQ ID NO: 48570
  Payload ID: 9770
  Gene Symbol: HLA-DPA1
  Gene Name: major histocompatibility complex, class II, DP alpha 1
  Uniprot ID: P20036
  ENSP ID: ENSP00000480187

SEQ ID NO: 48610 - protein, 258 aa, Homo sapiens
  Payload ID: 9771
  Gene Symbol: HLA-DPB1
  Gene Name: major histocompatibility complex, class II, DP beta 1
  ENSP ID: ENSP00000372582
MMVLQVSAAPRTVALTALLMVLLTSVVQGRATPENYVYQLRQECYAFNGTQRFLERYIYNREEFVRFDSDVGEFRAVTELGRPDEDYWNSQKDLLEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKVQRGSA

SEQ ID NO: 48611 - protein, 228 aa, Homo sapiens
  Payload ID: 9771
  Gene Symbol: HLA-DPB1
  Gene Name: major histocompatibility complex, class II, DP beta 1
  ENSP ID: ENSP00000382414
MMVLQVSAAPRTVALTALLMVLLTSVVQGRATPENYLFQGRQECYAFNGTQRFLERYIYNREELVRFDSDVGEFRAVTELGRPEAEYWNSQKDILEEERAVPDRMCRHNYELGGPMTLQRRGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 48612 - protein, 258 aa, Homo sapiens
  Payload ID: 9771
  Gene Symbol: HLA-DPB1
  Gene Name: major histocompatibility complex, class II, DP beta 1
  Uniprot ID: P04440
  ENSP ID: ENSP00000382422
MMVLQVSAAPRTVALTALLMVLLTSVVQGRATPENYLFQGRQECYAFNGTQRFLERYIYNREELVRFDSDVGEFRAVTELGRPEAEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 48613 - protein, 229 aa, Homo sapiens
  Payload ID: 9771
  Gene Symbol: HLA-DPB1
  Gene Name: major histocompatibility complex, class II, DP beta 1
  ENSP ID: ENSP00000385037
KQAWRGSATRLGPQNSGRQECYAFNGTQRFLERYIYNREELVRFDSDVGEFRAVTELGRPEAEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKK

SEQ ID NO: 48614 - protein, 228 aa, Homo sapiens
  Payload ID: 9771
  Gene Symbol: HLA-DPB1
  Gene Name: major histocompatibility complex, class II, DP beta 1
  ENSP ID: ENSP00000388249
MMVLQVSAAPRTVALTALLMVLLTSVVQGRATPENYLFQGRQECYAFNGTQRFLERYIYNREEFVRFDSDVGEFRAVTELGRPDEEYWNSQKDILEEERAVPDRMCRHNYELGGPMTLQRRGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 48615 - protein, 229 aa, Homo sapiens
  Payload ID: 9771
  Gene Symbol: HLA-DPB1
  Gene Name: major histocompatibility complex, class II, DP beta 1
  ENSP ID: ENSP00000389193
KQAWRGSATRLGPQNSLRQECYAFNGTQRFLERYIYNREEFVRFDSDVGEFRAVTELGRPDEDYWNSQKDLLEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKK

SEQ ID NO: 48616 - protein, 258 aa, Homo sapiens
  Payload ID: 9771
  Gene Symbol: HLA-DPB1
  Gene Name: major histocompatibility complex, class II, DP beta 1
  Uniprot ID: P04440
  ENSP ID: ENSP00000389288
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 48617 - protein, 235 aa, Homo sapiens
  Payload ID: 9771
  Gene Symbol: HLA-DPB1
  Gene Name: major histocompatibility complex, class II, DP beta 1
  ENSP ID: ENSP00000389618
  MOD_RES (1)..(1): Any amino acid
XNYLFQGRQECYAFNGTQRFLERYIYNREEFVRFDSDVGEFRAVTELGRPDEEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKGEKACRFNEDLHKQGS

SEQ ID NO: 48618 - protein, 235 aa, Homo sapiens
  Payload ID: 9771
  Gene Symbol: HLA-DPB1
  Gene Name: major histocompatibility complex, class II, DP beta 1
  ENSP ID: ENSP00000389923
  MOD_RES (1)..(1): Any amino acid
XNYLFQGRQECYAFNGTQRFLERYIYNREEFVRFDSDVGEFRAVTELGRPDEEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSMDSPVTVEWKAQSDSARSKTLTGAGGFVLGLIICGVGIFMHRRSKKGEKACRFNEDLHKQGS

SEQ ID NO: 48619 - protein, 229 aa, Homo sapiens
  Payload ID: 9771
  Gene Symbol: HLA-DPB1
  Gene Name: major histocompatibility complex, class II, DP beta 1
  ENSP ID: ENSP00000393651
KQAWRGSATRLGPQNSGRQECYAFNGTQRFLERYIYNREEFVRFDSDVGEFRAVTELGRPDEEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSMDSPVTVEWKAQSDSARSKTLTGAGGFVLGLIICGVGIFMHRRSKK

SEQ ID NO: 48620 - protein, 229 aa, Homo sapiens
  Payload ID: 9771
  Gene Symbol: HLA-DPB1
  Gene Name: major histocompatibility complex, class II, DP beta 1
  ENSP ID: ENSP00000393789
KQAWRGSATRLGPQNSGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKK

SEQ ID NO: 48621 - protein, 228 aa, Homo sapiens
  Payload ID: 9771
  Gene Symbol: HLA-DPB1
  Gene Name: major histocompatibility complex, class II, DP beta 1
  ENSP ID: ENSP00000395651
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 48622 - protein, 258 aa, Homo sapiens
  Payload ID: 9771
  Gene Symbol: HLA-DPB1
  Gene Name: major histocompatibility complex, class II, DP beta 1
  Uniprot ID: P04440
  ENSP ID: ENSP00000396095
MMVLQVSAAPRTVALTALLMVLLTSVVQGRATPENYLFQGRQECYAFNGTQRFLERYIYNREEFVRFDSDVGEFRAVTELGRPDEEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSMDSPVTVEWKAQSDSARSKTLTGAGGFVLGLIICGVGIFMHRRSKKVQRGSA

SEQ ID NO: 48623 - protein, 229 aa, Homo sapiens; identical to SEQ ID NO: 48619
  Payload ID: 9771
  Gene Symbol: HLA-DPB1
  Gene Name: major histocompatibility complex, class II, DP beta 1
  ENSP ID: ENSP00000396595

SEQ ID NO: 48624 - protein, 228 aa, Homo sapiens; identical to SEQ ID NO: 48621
  Payload ID: 9771
  Gene Symbol: HLA-DPB1
  Gene Name: major histocompatibility complex, class II, DP beta 1
  ENSP ID: ENSP00000398783

SEQ ID NO: 48625 - protein, 258 aa, Homo sapiens
  Payload ID: 9771
  Gene Symbol: HLA-DPB1
  Gene Name: major histocompatibility complex, class II, DP beta 1
  ENSP ID: ENSP00000399298
MMVLQVSAAPRTVALTALLMVLLTSVVQGRATPENYLFQGRQECYAFNGTQRFLERYIYNREEFVRFDSDVGEFRAVTELGRPDEEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 48626 - protein, 235 aa, Homo sapiens
  Payload ID: 9771
  Gene Symbol: HLA-DPB1
  Gene Name: major histocompatibility complex, class II, DP beta 1
  ENSP ID: ENSP00000399832
  MOD_RES (1)..(1): Any amino acid
XNYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKGEKACRFNEDLHKQGS

SEQ ID NO: 48627 - protein, 229 aa, Homo sapiens
  Payload ID: 9771
  Gene Symbol: HLA-DPB1
  Gene Name: major histocompatibility complex, class II, DP beta 1
  ENSP ID: ENSP00000399852
KQAWRGSATRLGPQNSGRQECYAFNGTQRFLERYIYNREEFVRFDSDVGEFRAVTELGRPDEEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKK

SEQ ID NO: 48628 - protein, 228 aa, Homo sapiens
  Payload ID: 9771
  Gene Symbol: HLA-DPB1
  Gene Name: major histocompatibility complex, class II, DP beta 1
  ENSP ID: ENSP00000400149
MMVLQVSAAPRTVALTALLMVLLTSVVQGRATPENYLFQGRQECYAFNGTQRFLERYIYNREEFVRFDSDVGEFRAVTELGRPDEEYWNSQKDILEEKRAVPDRMCRHNYELGGPMTLQRRGSIQVRWFLNGQEETAGVVSTNLIRNGDWTFQILVMLEMTPQQGDVYTCQVEHTSMDSPVTVEWKAQSDSARSKTLTGAGGFVLGLIICGVGIFMHRRSKKVQRGSA

SEQ ID NO: 48629 - protein, 235 aa, Homo sapiens; identical to SEQ ID NO: 48626
  Payload ID: 9771
  Gene Symbol: HLA-DPB1
  Gene Name: major histocompatibility complex, class II, DP beta 1
  ENSP ID: ENSP00000404116
  MOD_RES (1)..(1): Any amino acid

SEQ ID NO: 48630 - protein, 258 aa, Homo sapiens; identical to SEQ ID NO: 48616
  Payload ID: 9771
  Gene Symbol: HLA-DPB1
  Gene Name: major histocompatibility complex, class II, DP beta 1
  Uniprot ID: P04440
  ENSP ID: ENSP00000407674

SEQ ID NO: 48631 - protein, 258 aa, Homo sapiens; identical to SEQ ID NO: 48616
  Payload ID: 9771
  Gene Symbol: HLA-DPB1
  Gene Name: major histocompatibility complex, class II, DP beta 1
  Uniprot ID: P04440
  ENSP ID: ENSP00000408146

SEQ ID NO: 48632 - protein, 235 aa, Homo sapiens
  Payload ID: 9771
  Gene Symbol: HLA-DPB1
  Gene Name: major histocompatibility complex, class II, DP beta 1
  ENSP ID: ENSP00000408879
  MOD_RES (1)..(1): Any amino acid
XNYLFQGRQECYAFNGTQRFLERYIYNREELVRFDSDVGEFRAVTELGRPEAEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKGEKACRFNEDLHKQGS

SEQ ID NO: 48633 - protein, 229 aa, Homo sapiens; identical to SEQ ID NO: 48620
  Payload ID: 9771
  Gene Symbol: HLA-DPB1
  Gene Name: major histocompatibility complex, class II, DP beta 1
  ENSP ID: ENSP00000408940

SEQ ID NO: 48634 - protein, 235 aa, Homo sapiens; identical to SEQ ID NO: 48618
  Payload ID: 9771
  Gene Symbol: HLA-DPB1
  Gene Name: major histocompatibility complex, class II, DP beta 1
  ENSP ID: ENSP00000409943
  MOD_RES (1)..(1): Any amino acid

SEQ ID NO: 48635 - protein, 228 aa, Homo sapiens; identical to SEQ ID NO: 48628
  Payload ID: 9771
  Gene Symbol: HLA-DPB1
  Gene Name: major histocompatibility complex, class II, DP beta 1
  ENSP ID: ENSP00000411486

SEQ ID NO: 48636 - protein, 229 aa, Homo sapiens; identical to SEQ ID NO: 48620
  Payload ID: 9771
  Gene Symbol: HLA-DPB1
  Gene Name: major histocompatibility complex, class II, DP beta 1
  ENSP ID: ENSP00000412654

SEQ ID NO: 48637 - protein, 228 aa, Homo sapiens
  Payload ID: 9771
  Gene Symbol: HLA-DPB1
  Gene Name: major histocompatibility complex, class II, DP beta 1
  ENSP ID: ENSP00000412855
MMVLQVSAAPRTVALTALLMVLLTSVVQGRATPENYVYQLRQECYAFNGTQRFLERYIYNREEFVRFDSDVGEFRAVTELGRPDEDYWNSQKDLLEEKRAVPDRVCRHNYELDEAVTLQRRGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKVQRGSA

SEQ ID NO: 48638 - protein, 258 aa, Homo sapiens; identical to SEQ ID NO: 48622
  Payload ID: 9771
  Gene Symbol: HLA-DPB1
  Gene Name: major histocompatibility complex, class II, DP beta 1
  Uniprot ID: P04440
  ENSP ID: ENSP00000414196

SEQ ID NO: 48639 - protein, 235 aa, Homo sapiens; identical to SEQ ID NO: 48626
  Payload ID: 9771
  Gene Symbol: HLA-DPB1
  Gene Name: major histocompatibility complex, class II, DP beta 1
  ENSP ID: ENSP00000416774
  MOD_RES (1)..(1): Any amino acid

SEQ ID NO: 48640 - protein, 235 aa, Homo sapiens
  Payload ID: 9771
  Gene Symbol: HLA-DPB1
  Gene Name: major histocompatibility complex, class II, DP beta 1
  ENSP ID: ENSP00000416855
  MOD_RES (1)..(1): Any amino acid
XNYVYQLRQECYAFNGTQRFLERYIYNREEFVRFDSDVGEFRAVTELGRPDEDYWNSQKDLLEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKGEKACKFNEDLHKQGS

SEQ ID NO: 48641 - protein, 255 aa, Homo sapiens
  Payload ID: 9772
  Gene Symbol: HLA-DQA1
  Gene Name: major histocompatibility complex, class II, DQ alpha 1
  Uniprot ID: P01909
  ENSP ID: ENSP00000339398
MILNKALLLGALALTTVMSPCGGEDIVADHVASCGVNLYQFYGPSGQYTHEFDGDEQFYVDLERKETAWRWPEFSKFGGFDPQGALRNMAVAKHNLNIMIKRYNSTAATNEVPEVTVFSKSPVTLGQPNTLICLVDNIFPPVVNITWLSNGQSVTEGVSETSFLSKSDHSFFKISYLTFLPSADEIYDCKVEHWGLDQPLLKHWEPEIPAPMSELTETVVCALGLSVGLMGIVVGTVFIIQGLRSVGASRHQGPL

SEQ ID NO: 48642 - protein, 255 aa, Homo sapiens; identical to SEQ ID NO: 48641
  Payload ID: 9772
  Gene Symbol: HLA-DQA1
  Gene Name: major histocompatibility complex, class II, DQ alpha 1
  Uniprot ID: P01909
  ENSP ID: ENSP00000364087

SEQ ID NO: 48643 - protein, 254 aa, Homo sapiens
  Payload ID: 9772
  Gene Symbol: HLA-DQA1
  Gene Name: major histocompatibility complex, class II, DQ alpha 1
  Uniprot ID: P01909
  ENSP ID: ENSP00000372738
MILNKALMLGALALTTVMSPCGGEDIVADHVASYGVNLYQSYGPSGQYTHEFDGDEQFYVDLGRKETVWCLPVLRQFRFDPQFALTNIAVLKHNLNSLIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTETVVCALGLSVGLVGIVVGTVFIIRGLRSVGASRHQGPL

SEQ ID NO: 48644 - protein, 255 aa, Homo sapiens; identical to SEQ ID NO: 48641
  Payload ID: 9772
  Gene Symbol: HLA-DQA1
  Gene Name: major histocompatibility complex, class II, DQ alpha 1
  Uniprot ID: P01909
  ENSP ID: ENSP00000378767

SEQ ID NO: 48645 - protein, 254 aa, Homo sapiens; identical to SEQ ID NO: 48643
  Payload ID: 9772
  Gene Symbol: HLA-DQA1
  Gene Name: major histocompatibility complex, class II, DQ alpha 1
  Uniprot ID: P01909
  ENSP ID: ENSP00000382583

SEQ ID NO: 48646 - protein, 254 aa, Homo sapiens; identical to SEQ ID NO: 48643
  Payload ID: 9772
  Gene Symbol: HLA-DQA1
  Gene Name: major histocompatibility complex, class II, DQ alpha 1
  Uniprot ID: P01909
  ENSP ID: ENSP00000382586

SEQ ID NO: 48647 - protein, 255 aa, Homo sapiens
  Payload ID: 9772
  Gene Symbol: HLA-DQA1
  Gene Name: major histocompatibility complex, class II, DQ alpha 1
  Uniprot ID: P01909
  ENSP ID: ENSP00000387892
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWEPEIPTPMSELTETVVCALGLSVGLVGIVVGTVLIIRGLRSVGASRHQGPL

SEQ ID NO: 48648 - protein, 255 aa, Homo sapiens
  Payload ID: 9772
  Gene Symbol: HLA-DQA1
  Gene Name: major histocompatibility complex, class II, DQ alpha 1
  ENSP ID: ENSP00000392580
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSDDEIYDCKVEHWGLDEPLLKHWEPEIPTPMSELTETVVCALGLSVGLVGIVVGTVLIIRGLRSVGASRHQGPL

SEQ ID NO: 48649 - protein, 24 aa, Homo sapiens
  Payload ID: 9772
  Gene Symbol: HLA-DQA1
  Gene Name: major histocompatibility complex, class II, DQ alpha 1
  ENSP ID: ENSP00000394388
MILNKALMLGALALTTVMSPCGGE

SEQ ID NO: 48650 - protein, 255 aa, Homo sapiens; identical to SEQ ID NO: 48648
  Payload ID: 9772
  Gene Symbol: HLA-DQA1
  Gene Name: major histocompatibility complex, class II, DQ alpha 1
  ENSP ID: ENSP00000399068

SEQ ID NO: 48651 - protein, 254 aa, Homo sapiens
  Payload ID: 9772
  Gene Symbol: HLA-DQA1
  Gene Name: major histocompatibility complex, class II, DQ alpha 1
  ENSP ID: ENSP00000401151
MILNKALMLGALALTTVMSPCGGEDIVADHVASYGVNLYQSYGPSGQFTHEFDGDEEFYVDLERKETVWKLPLFHRLRFDPQFALTNIAVLKHNLNILIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWEPEIPAPMSELTETVVCALGLSVGLVGIVVGTVLIIRGLRSVGASRHQGPL

SEQ ID NO: 48652 - protein, 254 aa, Homo sapiens; identical to SEQ ID NO: 48651
  Payload ID: 9772
  Gene Symbol: HLA-DQA1
  Gene Name: major histocompatibility complex, class II, DQ alpha 1
  ENSP ID: ENSP00000401436

SEQ ID NO: 48653 - protein, 254 aa, Homo sapiens; identical to SEQ ID NO: 48651
  Payload ID: 9772
  Gene Symbol: HLA-DQA1
  Gene Name: major histocompatibility complex, class II, DQ alpha 1
  ENSP ID: ENSP00000401760

SEQ ID NO: 48654 - protein, 255 aa, Homo sapiens; identical to SEQ ID NO: 48648
  Payload ID: 9772
  Gene Symbol: HLA-DQA1
  Gene Name: major histocompatibility complex, class II, DQ alpha 1
  ENSP ID: ENSP00000404172

SEQ ID NO: 48655 - protein, 254 aa, Homo sapiens; identical to SEQ ID NO: 48651
  Payload ID: 9772
  Gene Symbol: HLA-DQA1
  Gene Name: major histocompatibility complex, class II, DQ alpha 1
  ENSP ID: ENSP00000405476

SEQ ID NO: 48656 - protein, 24 aa, Homo sapiens
  Payload ID: 9772
  Gene Symbol: HLA-DQA1
  Gene Name: major histocompatibility complex, class II, DQ alpha 1
  ENSP ID: ENSP00000405797
MILNKALLLGALALTTVMSPCGGE

SEQ ID NO: 48657 - protein, 254 aa, Homo sapiens; identical to SEQ ID NO: 48651
  Payload ID: 9772
  Gene Symbol: HLA-DQA1
  Gene Name: major histocompatibility complex, class II, DQ alpha 1
  ENSP ID: ENSP00000409127

SEQ ID NO: 48658 - protein, 254 aa, Homo sapiens; identical to SEQ ID NO: 48651
  Payload ID: 9772
  Gene Symbol: HLA-DQA1
  Gene Name: major histocompatibility complex, class II, DQ alpha 1
  ENSP ID: ENSP00000412055

SEQ ID NO: 48659 - protein, 255 aa, Homo sapiens; identical to SEQ ID NO: 48647
  Payload ID: 9772
  Gene Symbol: HLA-DQA1
  Gene Name: major histocompatibility complex, class II, DQ alpha 1
  Uniprot ID: P01909
  ENSP ID: ENSP00000413237

SEQ ID NO: 48660 - protein, 24 aa, Homo sapiens
  Payload ID: 9772
  Gene Symbol: HLA-DQA1
  Gene Name: major histocompatibility complex, class II, DQ alpha 1
  ENSP ID: ENSP00000413815
MILNKALMLGALALTTVMSPCGGE

SEQ ID NO: 48661 - protein, 24 aa, Homo sapiens
  Payload ID: 9772
  Gene Symbol: HLA-DQA1
  Gene Name: major histocompatibility complex, class II, DQ alpha 1
  ENSP ID: ENSP00000413816
MILNKALMLGALALTTVMSPCGGE

SEQ ID NO: 48662 - protein, 255 aa, Homo sapiens; identical to SEQ ID NO: 48648
  Payload ID: 9772
  Gene Symbol: HLA-DQA1
  Gene Name: major histocompatibility complex, class II, DQ alpha 1
  ENSP ID: ENSP00000414360

SEQ ID NO: 48663 - protein, 254 aa, Homo sapiens; identical to SEQ ID NO: 48651
  Payload ID: 9772
  Gene Symbol: HLA-DQA1
  Gene Name: major histocompatibility complex, class II, DQ alpha 1
  ENSP ID: ENSP00000415001

SEQ ID NO: 48664 - protein, 254 aa, Homo sapiens; identical to SEQ ID NO: 48651
  Payload ID: 9772
  Gene Symbol: HLA-DQA1
  Gene Name: major histocompatibility complex, class II, DQ alpha 1
  ENSP ID: ENSP00000416641

SEQ ID NO: 48665 - protein, 115 aa, Homo sapiens
  Payload ID: 9772
  Gene Symbol: HLA-DQA1
  Gene Name: major histocompatibility complex, class II, DQ alpha 1
  ENSP ID: ENSP00000431277
MILNKALMLGALALTTVMSPCGGEDIVGSISDSLLLYRDGHEFVKQKLKSQIVKRGSKLEGTLNFHNLINRGSSHSDFVQQWKFHPLLQSAWLLCSKFPFFSLTPECPGQAQLIH

SEQ ID NO: 48666 - protein, 115 aa, Homo sapiens; identical to SEQ ID NO: 48665
  Payload ID: 9772
  Gene Symbol: HLA-DQA1
  Gene Name: major histocompatibility complex, class II, DQ alpha 1
  ENSP ID: ENSP00000436314

SEQ ID NO: 48667 - protein, 53 aa, Homo sapiens
  Payload ID: 9772
  Gene Symbol: HLA-DQA1
  Gene Name: major histocompatibility complex, class II, DQ alpha 1
  ENSP ID: ENSP00000436546
MILNKALLLGALALTTVMSPCGGEDIVGSISDSLLLYRDGQWVCKTKVEKSDS

SEQ ID NO: 48668 - protein, 41 aa, Homo sapiens
  Payload ID: 9772
  Gene Symbol: HLA-DQA1
  Gene Name: major histocompatibility complex, class II, DQ alpha 1
  ENSP ID: ENSP00000436724
MILNKALMLGALALTTVMSPCGGEDIVGSISDSLLLYRDGQ

SEQ ID NO: 48669 - protein, 214 aa, Homo sapiens
  Payload ID: 9772
  Gene Symbol: HLA-DQA1
  Gene Name: major histocompatibility complex, class II, DQ alpha 1
  ENSP ID: ENSP00000437302
MILNKALLLGALALTTVMSPCGGEDIVADHVASCGVNLYQFYGPSGQYTHEFDGDEQFYVDLERKETAWRWPEFSKFGGFDPQGALRNMAVAKHNLNIMIKRYNSTAATNEVPEVTVFSKSPVTLGQPNTLICLVDNIFPPVVNITWLSNGQSVTEGVSETSFLSKSDHSFFKISYLTFLPSADEIYDCKVEHWGLDQPLLKHWGASPSTGAEE

SEQ ID NO: 48670 - protein, 254 aa, Homo sapiens; identical to SEQ ID NO: 48643
  Payload ID: 9772
  Gene Symbol: HLA-DQA1
  Gene Name: major histocompatibility complex, class II, DQ alpha 1
  Uniprot ID: P01909
  ENSP ID: ENSP00000447970

SEQ ID NO: 48671 - protein, 255 aa, Homo sapiens
  Payload ID: 9772
  Gene Symbol: HLA-DQA1
  Gene Name: major histocompatibility complex, class II, DQ alpha 1
  ENSP ID: ENSP00000449970
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWEPEIPAPMSELTETLVCALGLSVGLMGIVVGTVFIIQGLRSVGASRHQGLL

SEQ ID NO: 48672 - protein, 255 aa, Homo sapiens
  Payload ID: 9772
  Gene Symbol: HLA-DQA1
  Gene Name: major histocompatibility complex, class II, DQ alpha 1
  ENSP ID: ENSP00000483966
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWEPEIPAPMSELTETLVCALGLSVGLMGIVVGTVFIIQGLRSVDASRHQGLL

SEQ ID NO: 48673 - protein, 255 aa, Homo sapiens
  Payload ID: 9773
  Gene Symbol: HLA-DQA2
  Gene Name: major histocompatibility complex, class II, DQ alpha 2
  Uniprot ID: P01906
  ENSP ID: ENSP00000241802
MILNKALLLGALALTAVMSPCGGEDIVADHVASYGVNFYQSHGPSGQYTHEFDGDEEFYVDLETKETVWQLPMFSKFISFDPQSALRNMAVGKHTLEFMMRQSNSTAATNEVPEVTVFSKFPVTLGQPNTLICLVDNIFPPVVNITWLSNGHSVTEGVSETSFLSKSDHSFFKISYLTFLPSADEIYDCKVEHWGLDEPLLKHWEPEIPAPMSELTETLVCALGLSVGLMGIVVGTVFIIQGLRSVDASRHQGLL

SEQ ID NO: 48674 - protein, 255 aa, Homo sapiens
  Payload ID: 9773
  Gene Symbol: HLA-DQA2
  Gene Name: major histocompatibility complex, class II, DQ alpha 2
  Uniprot ID: P01906
  ENSP ID: ENSP00000364076
MILNKALLLGALALTAVMSPCGGEDIVADHVASYGVNFYQSHGPSGQYTHEFDGDEEFYVDLETKETVWQLPMFSKFISFDPQSALRNMAVGKHTLEFMMRQSNSTAATNEVPEVTVFSKFPVTLGQPNTLICLVDNIFPPVVNITWLSNGHSVTEGVSETSFLSKSDHSFFKISYLTFLPSADEIYDCKVEHWGLDEPLLKHWEPEIPAPMSELTETLVCALGLSVGLMGIVVGTVFIIQGLRSVGASRHQGLL

SEQ ID NO: 48675 - protein, 255 aa, Homo sapiens [sequence omitted]

SEQ ID NO: 48676 - protein, 255 aa, Homo sapiens [sequence omitted]

SEQ ID NO: 48677 - protein, 255 aa, Homo sapiens; identical to SEQ ID NO: 48674
  Payload ID: 9773
  Gene Symbol: HLA-DQA2
  Gene Name: major histocompatibility complex, class II, DQ alpha 2
  Uniprot ID: P01906
  ENSP ID: ENSP00000393431

SEQ ID NO: 48678 - protein, 255 aa, Homo sapiens [sequence omitted]

SEQ ID NO: 48679 - protein, 255 aa, Homo sapiens; identical to SEQ ID NO: 48674
  Payload ID: 9773
  Gene Symbol: HLA-DQA2
  Gene Name: major histocompatibility complex, class II, DQ alpha 2
  Uniprot ID: P01906
  ENSP ID: ENSP00000401098

SEQ ID NO: 48680 - protein, 255 aa, Homo sapiens; identical to SEQ ID NO: 48674
  Payload ID: 9773
  Gene Symbol: HLA-DQA2
  Gene Name: major histocompatibility complex, class II, DQ alpha 2
  Uniprot ID: P01906
  ENSP ID: ENSP00000405833

SEQ ID NO: 48681 - protein, 255 aa, Homo sapiens; identical to SEQ ID NO: 48673
  Payload ID: 9773
  Gene Symbol: HLA-DQA2
  Gene Name: major histocompatibility complex, class II, DQ alpha 2
  ENSP ID: ENSP00000446860

SEQ ID NO: 48682 - protein, 254 aa, Homo sapiens; identical to SEQ ID NO: 48643
  Payload ID: 9773
  Gene Symbol: HLA-DQA2
  Gene Name: major histocompatibility complex, class II, DQ alpha 2
  ENSP ID: ENSP00000447257

SEQ ID NO: 48683 - protein, 255 aa, Homo sapiens; identical to SEQ ID NO: 48674
  Payload ID: 9773
  Gene Symbol: HLA-DQA2
  Gene Name: major histocompatibility complex, class II, DQ alpha 2
  Uniprot ID: P01906
  ENSP ID: ENSP00000447668

SEQ ID NO: 48684 - protein, 255 aa, Homo sapiens; identical to SEQ ID NO: 48674
  Payload ID: 9773
  Gene Symbol: HLA-DQA2
  Gene Name: major histocompatibility complex, class II, DQ alpha 2
  Uniprot ID: P01906
  ENSP ID: ENSP00000448003

SEQ ID NO: 48685 - protein, 254 aa, Homo sapiens; identical to SEQ ID NO: 48643
  Payload ID: 9773
  Gene Symbol: HLA-DQA2
  Gene Name: major histocompatibility complex, class II, DQ alpha 2
  ENSP ID: ENSP00000449195

SEQ ID NO: 48686 - protein, 269 aa, Homo sapiens
  Payload ID: 9774
  Gene Symbol: HLA-DQB1
  Gene Name: major histocompatibility complex, class II, DQ beta 1
  ENSP ID: ENSP00000364080
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRAQSESAQSKMLSGVGGFVLGLIFLGLGLIIRQRSQKGPQGPPPAGLLH

SEQ ID NO: 48687 - protein, 261 aa, Homo sapiens
  Payload ID: 9774
  Gene Symbol: HLA-DQB1
  Gene Name: major histocompatibility complex, class II, DQ beta 1
  ENSP ID: ENSP00000372602
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNDQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 48688 - protein, 261 aa, Homo sapiens; identical to SEQ ID NO: 48687
  Payload ID: 9774
  Gene Symbol: HLA-DQB1
  Gene Name: major histocompatibility complex, class II, DQ beta 1
  ENSP ID: ENSP00000372734

SEQ ID NO: 48689 - protein, 269 aa, Homo sapiens
  Payload ID: 9774
  Gene Symbol: HLA-DQB1
  Gene Name: major histocompatibility complex, class II, DQ beta 1
  ENSP ID: ENSP00000382018
MSWKKALRIPGGLRAATVTLMLAMLSTPVAEGRDSPEDFVYQFKAMCYFTNGTERVRYVTRYIYNREEYARFDSDVEVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQHGDVYTCHVEHPSLQNPITVEWRAQSESAQSKMLSGIGGFVLGLIFLGLGLIIHHRSQKGPQGPPPAGLLH

SEQ ID NO: 48690 - protein, 269 aa, Homo sapiens
  Payload ID: 9774
  Gene Symbol: HLA-DQB1
  Gene Name: major histocompatibility complex, class II, DQ beta 1
  ENSP ID: ENSP00000382025
MSWKKALRIPGGLRVATVTLMLAMLSTPVAEGRDSPEDFVYQFKGMCYFTNGTERVRLVTRYIYNREEYARFDSDVGVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQRGDVYTCHVEHPSLQNPIIVEWRAQSESAQSKMLSGIGGFVLGLIFLGLGLIIHHRSQKGPQGPPPAGLLH

SEQ ID NO: 48691 - protein, 224 aa, Homo sapiens
  Payload ID: 9774
  Gene Symbol: HLA-DQB1
  Gene Name: major histocompatibility complex, class II, DQ beta 1
  ENSP ID: ENSP00000382029
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRLLH

SEQ ID NO: 48692 - protein, 134 aa, Homo sapiens
  Payload ID: 9774
  Gene Symbol: HLA-DQB1
  Gene Name: major histocompatibility complex, class II, DQ beta 1
  ENSP ID: ENSP00000382032
MSWKKALRIPGDLRVATVTLMLAMLSSLLAEGRDSPVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRLLH

SEQ ID NO: 48693 - protein, 261 aa, Homo sapiens
  Payload ID: 9774
  Gene Symbol: HLA-DQB1
  Gene Name: major histocompatibility complex, class II, DQ beta 1
  ENSP ID: ENSP00000382034
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRAQSESAQSKMLSGVGGFVLGLIFLGLGLIIRQRSQKGLLH

SEQ ID NO: 48694 - protein, 261 aa, Homo sapiens
  Payload ID: 9774
  Gene Symbol: HLA-DQB1
  Gene Name: major histocompatibility complex, class II, DQ beta 1
  Uniprot ID: P01920
  ENSP ID: ENSP00000382038
MSWKKALRIPGGLRAATVTLMLAMLSTPVAEGRDSPEDFVYQFKAMCYFTNGTERVRYVTRYIYNREEYARFDSDVEVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQHGDVYTCHVEHPSLQNPITVEWRAQSESAQSKMLSGIGGFVLGLIFLGLGLIIHHRSQKGLLH

SEQ ID NO: 48695 - protein, 224 aa, Homo sapiens
  Payload ID: 9774
  Gene Symbol: HLA-DQB1
  Gene Name: major histocompatibility complex, class II, DQ beta 1
  ENSP ID: ENSP00000382578
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNDQEETAGVVSTPLIRNGDWTFQILVMLEMTPQRGDVYTCHVEHPSLQSPITVEWRLLH

SEQ ID NO: 48696 - protein, 134 aa, Homo sapiens
  Payload ID: 9774
  Gene Symbol: HLA-DQB1
  Gene Name: major histocompatibility complex, class II, DQ beta 1
  ENSP ID: ENSP00000388447
MSWKKALRIPGGLRVATVTLMLAMLSTPVAEGRDSPVEPTVTISPSRTEALNHHNLLVCSVTDFYPAQIKVRWFRNDQEETTGVVSTPLIRNGDWTFQILVMLEMTPQRGDVYTCHVEHPSLQNPIIVEWRLLH

SEQ ID NO: 48697 - protein, 261 aa, Homo sapiens
  Payload ID: 9774
  Gene Symbol: HLA-DQB1
  Gene Name: major histocompatibility complex, class II, DQ beta 1
  ENSP ID: ENSP00000388763
MSWKKALRIPGGLRVATVTLMLAMLSTPVAEGRDSPEDFVYQFKGMCYFTNGTERVRGVTRYIYNREEYARFDSDVGVYRAVTPLGPPAAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQRGDVYTCHVEHPSLQNPIIVEWRAQSESAQSKMLSGIGGFVLGLIFLGLGLIIHHRSQKGLLH

SEQ ID NO: 48698 - protein, 224 aa, Homo sapiens
  Payload ID: 9774
  Gene Symbol: HLA-DQB1
  Gene Name: major histocompatibility complex, class II, DQ beta 1
  ENSP ID: ENSP00000393979
MSWKKALRIPGGLRVATVTLMLAMLSTPVAEGRDSPEDFVYQFKGMCYFTNGTERVRLVTRYIYNREEYARFDSDVGVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQRGDVYTCHVEHPSLQNPIIVEWRLLH

SEQ ID NO: 48699 - protein, 144 aa, Homo sapiens
  Payload ID: 9774
  Gene Symbol: HLA-DQB1
  Gene Name: major histocompatibility complex, class II, DQ beta 1
  ENSP ID: ENSP00000394159
MSWKKALRIPGGLRVATVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQRGDVYTCHVE

SEQ ID NO: 48700 - protein, 261 aa, Homo sapiens; identical to SEQ ID NO: 48694
  Payload ID: 9774
  Gene Symbol: HLA-DQB1
  Gene Name: major histocompatibility complex, class II, DQ beta 1
  Uniprot ID: P01920
  ENSP ID: ENSP00000396539

SEQ ID NO: 48701 - protein, 261 aa, Homo sapiens
  Payload ID: 9774
  Gene Symbol: HLA-DQB1
  Gene Name: major histocompatibility complex, class II, DQ beta 1
  Uniprot ID: P01920
  ENSP ID: ENSP00000402865
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNGQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 48702 - protein, 144 aa, Homo sapiens
  Payload ID: 9774
  Gene Symbol: HLA-DQB1
  Gene Name: major histocompatibility complex, class II, DQ beta 1
  ENSP ID: ENSP00000403786
MSWKKALRIPGGLRAATVTLLGLPAAEYWNSQKDILERKRAAVDRVCRHNYQLELRTTLQRRVEPTVTISPSRTEALNHHNLLVCSVTDFYPAQIKVRWFRNGQEETAGVVSTPLIRNGDWTFQILVMLEMTPQRGDVYTCHVE

SEQ ID NO: 48703 - protein, 134 aa, Homo sapiens
  Payload ID: 9774
  Gene Symbol: HLA-DQB1
  Gene Name: major histocompatibility complex, class II, DQ beta 1
  ENSP ID: ENSP00000406962
MSWKKALRIPGGLRAATVTLMLSMLSTPVAEGRDSPVEPTVTISPSRTEALNHHNLLVCSVTDFYPAQIKVRWFRNGQEETAGVVSTPLIRNGDWTFQILVMLEMTPQRGDVYTCHVEHPSLQSPITVEWRLLH

SEQ ID NO: 48704 - protein, 261 aa, Homo sapiens; identical to SEQ ID NO: 48693
  Payload ID: 9774
  Gene Symbol: HLA-DQB1
  Gene Name: major histocompatibility complex, class II, DQ beta 1
  ENSP ID: ENSP00000407332

SEQ ID NO: 48705 - protein, 261 aa, Homo sapiens [sequence omitted]

SEQ ID NO: 48706 - protein, 261 aa, Homo sapiens; identical to SEQ ID NO: 48701
  Payload ID: 9774
  Gene Symbol: HLA-DQB1
  Gene Name: major histocompatibility complex, class II, DQ beta 1
  Uniprot ID: P01920
  ENSP ID: ENSP00000410330

SEQ ID NO: 48707 - protein, 269 aa, Homo sapiens
  Payload ID: 9774
  Gene Symbol: HLA-DQB1
  Gene Name: major histocompatibility complex, class II, DQ beta 1
  ENSP ID: ENSP00000411427
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNGQEETAGVVSTPLIRNGDWTFQILVMLEMTPQRGDVYTCHVEHPSLQSPITVEWRAQSESAQSKMLSGIGGFVLGLIFLGLGLIIHHRSQKGPQGPPPAGLLH

SEQ ID NO: 48708 - protein, 224 aa, Homo sapiens
  Payload ID: 9774
  Gene Symbol: HLA-DQB1
  Gene Name: major histocompatibility complex, class II, DQ beta 1
  ENSP ID: ENSP00000411566
MSWKKALRIPGGLRAATVTLMLAMLSTPVAEGRDSPEDFVYQFKAMCYFTNGTERVRYVTRYIYNREEYARFDSDVEVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQHGDVYTCHVEHPSLQNPITVEWRLLH

SEQ ID NO: 48709 - protein, 224 aa, Homo sapiens
  Payload ID: 9774
  Gene Symbol: HLA-DQB1
  Gene Name: major histocompatibility complex, class II, DQ beta 1
  ENSP ID: ENSP00000412380
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNGQEETAGVVSTPLIRNGDWTFQILVMLEMTPQRGDVYTCHVEHPSLQSPITVEWRLLH

SEQ ID NO: 48710 - protein, 261 aa, Homo sapiens [sequence omitted]

SEQ ID NO: 48711 - protein, 134 aa, Homo sapiens
  Payload ID: 9774
  Gene Symbol: HLA-DQB1
  Gene Name: major histocompatibility complex, class II, DQ beta 1
  ENSP ID: ENSP00000414555
MSWKKALRIPGGLRAATVTLMLAMLSTPVAEGRDSPVEPTVTISPSRTEALNHHNLLVCSVTDFYPAQIKVRWFRNDQEETTGVVSTPLIRNGDWTFQILVMLEMTPQHGDVYTCHVEHPSLQNPITVEWRLLH

SEQ ID NO: 48712 - protein, 144 aa, Homo sapiens
  Payload ID: 9774
  Gene Symbol: HLA-DQB1
  Gene Name: major histocompatibility complex, class II, DQ beta 1
  ENSP ID: ENSP00000416744
MSWKKALRIPGGLRAATVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQHGDVYTCHVE

SEQ ID NO: 48713 - protein, 136 aa, Homo sapiens
  Payload ID: 9774
  Gene Symbol: HLA-DQB1
  Gene Name: major histocompatibility complex, class II, DQ beta 1
  ENSP ID: ENSP00000433300
MSWKKALRIPGGLRVATVTLMLAMLSTPVAEGRDSPEDFVYQFKGMCYFTNGTERVRLVTRYIYNREEYARFDSDVGVYRAVTPLGPPDAEYWNSQKEVLERTRAELDTVCRHNYQLELRTTLQRRGTVTGPSRSW

SEQ ID NO: 48714 - protein, 136 aa, Homo sapiens
  Payload ID: 9774
  Gene Symbol: HLA-DQB1
  Gene Name: major histocompatibility complex, class II, DQ beta 1
  ENSP ID: ENSP00000435178
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRGMVTGPSRSW

SEQ ID NO: 48715 - protein, 136 aa, Homo sapiens
  Payload ID: 9774
  Gene Symbol: HLA-DQB1
  Gene Name: major histocompatibility complex, class II, DQ beta 1
  ENSP ID: ENSP00000435701
MSWKKALRIPGGLRAATVTLMLAMLSTPVAEGRDSPEDFVYQFKAMCYFTNGTERVRYVTRYIYNREEYARFDSDVEVYRAVTPLGPPDAEYWNSQKEVLERTRAELDTVCRHNYQLELRTTLQRRGTVTGPSRSW

SEQ ID NO: 48716 - protein, 136 aa, Homo sapiens
  Payload ID: 9774
  Gene Symbol: HLA-DQB1
  Gene Name: major histocompatibility complex, class II, DQ beta 1
  ENSP ID: ENSP00000436686
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRGMVTGLSRSW

SEQ ID NO: 48717 - protein, 279 aa, Homo sapiens
  Payload ID: 9775
  Gene Symbol: HLA-DQB2
  Gene Name: major histocompatibility complex, class II, DQ beta 2
  ENSP ID: ENSP00000322293
MSWKMALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVQWFRNDQEETAGVVSTSLIRNGDWTFQILVMLEITPQRGDIYTCQVEHPSLQSPITVEWRAQSESAQSKMLGGVGGFVLGLIFLGLGLIIRHRGQKGPRGPPPAGNISAMIQSGERAQA

SEQ ID NO: 48718 - protein, 231 aa, Homo sapiens
  Payload ID: 9775
  Gene Symbol: HLA-DQB2
  Gene Name: major histocompatibility complex, class II, DQ beta 2
  ENSP ID: ENSP00000382566
MSWKMALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVQWFRNDQEETAGVVSTSLIRNGDWTFQILVMLEITPQRGDIYTCQVEHPSLQSPITVEWRPRGPPPAGLLH

SEQ ID NO: 48719 - protein, 268 aa, Homo sapiens
  Payload ID: 9775
  Gene Symbol: HLA-DQB2
  Gene Name: major histocompatibility complex, class II, DQ beta 2
  Uniprot ID: P05538
  ENSP ID: ENSP00000382569
MSWKMALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVQWFRNDQEETAGVVSTSLIRNGDWTFQILVMLEITPQRGDIYTCQVEHPSLQSPITVEWRAQSESAQSKMLGGVGGFVLGLIFLGLGLIIRHRGQKGPRGPPPAGLLH

SEQ ID NO: 48720 - protein, 275 aa, Homo sapiens
  Payload ID: 9775
  Gene Symbol: HLA-DQB2
  Gene Name: major histocompatibility complex, class II, DQ beta 2
  ENSP ID: ENSP00000387578
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRAQSESAQSKMLSGIGGFVLGLIFLGLGLIIRHRGQKGPRGPPPAGNISAMIQSGERAQA

SEQ ID NO: 48721 - protein, 264 aa, Homo sapiens
  Payload ID: 9775
  Gene Symbol: HLA-DQB2
  Gene Name: major histocompatibility complex, class II, DQ beta 2
  ENSP ID: ENSP00000388849
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRAQSESAQSKMLSGIGGFVLGLIFLGLGLIIRHRGQKGPRGPPPAGLLH

SEQ ID NO: 48722 - protein, 268 aa, Homo sapiens; identical to SEQ ID NO: 48719
  Payload ID: 9775
  Gene Symbol: HLA-DQB2
  Gene Name: major histocompatibility complex, class II, DQ beta 2
  Uniprot ID: P05538
  ENSP ID: ENSP00000389067

SEQ ID NO: 48723 - protein, 227 aa, Homo sapiens
  Payload ID: 9775
  Gene Symbol: HLA-DQB2
  Gene Name: major histocompatibility complex, class II, DQ beta 2
  Uniprot ID: P05538
  ENSP ID: ENSP00000390431
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRPRGPPPAGLLH

SEQ ID NO: 48724 - protein, 279 aa, Homo sapiens; identical to SEQ ID NO: 48717
  Payload ID: 9775
  Gene Symbol: HLA-DQB2
  Gene Name: major histocompatibility complex, class II, DQ beta 2
  ENSP ID: ENSP00000391938

SEQ ID NO: 48725 - protein, 264 aa, Homo sapiens; identical to SEQ ID NO: 48721
  Payload ID: 9775
  Gene Symbol: HLA-DQB2
  Gene Name: major histocompatibility complex, class II, DQ beta 2
  ENSP ID: ENSP00000392299

SEQ ID NO: 48726 - protein, 227 aa, Homo sapiens; identical to SEQ ID NO: 48723
  Payload ID: 9775
  Gene Symbol: HLA-DQB2
  Gene Name: major histocompatibility complex, class II, DQ beta 2
  Uniprot ID: P05538
  ENSP ID: ENSP00000393969

SEQ ID NO: 48727 - protein, 231 aa, Homo sapiens; identical to SEQ ID NO: 48718
  Payload ID: 9775
  Gene Symbol: HLA-DQB2
  Gene Name: major histocompatibility complex, class II, DQ beta 2
  ENSP ID: ENSP00000394016

SEQ ID NO: 48728 - protein, 279 aa, Homo sapiens; identical to SEQ ID NO: 48717
  Payload ID: 9775
  Gene Symbol: HLA-DQB2
  Gene Name: major histocompatibility complex, class II, DQ beta 2
  ENSP ID: ENSP00000394272

SEQ ID NO: 48729 - protein, 275 aa, Homo sapiens; identical to SEQ ID NO: 48720
  Payload ID: 9775
  Gene Symbol: HLA-DQB2
  Gene Name: major histocompatibility complex, class II, DQ beta 2
  ENSP ID: ENSP00000394759

SEQ ID NO: 48730 - protein, 218 aa, Homo sapiens
  Payload ID: 9775
  Gene Symbol: HLA-DQB2
  Gene Name: major histocompatibility complex, class II, DQ beta 2
  ENSP ID: ENSP00000396323
  MOD_RES (1)..(1): Any amino acid
XLQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVQWFRNDQEETAGVVSTSLIRNGDWTFQILVMLEITPQRGDIYTCQVEHPSLQSPITVEWRLLH

SEQ ID NO: 48731 - protein, 264 aa, Homo sapiens; identical to SEQ ID NO: 48721
  Payload ID: 9775
  Gene Symbol: HLA-DQB2
  Gene Name: major histocompatibility complex, class II, DQ beta 2
  ENSP ID: ENSP00000396330

SEQ ID NO: 48732 - protein, 268 aa, Homo sapiens; identical to SEQ ID NO: 48719
  Payload ID: 9775
  Gene Symbol: HLA-DQB2
  Gene Name: major histocompatibility complex, class II, DQ beta 2
  Uniprot ID: P05538
  ENSP ID: ENSP00000396502

SEQ ID NO: 48733 - protein, 218 aa, Homo sapiens; identical to SEQ ID NO: 48730
  Payload ID: 9775
  Gene Symbol: HLA-DQB2
  Gene Name: major histocompatibility complex, class II, DQ beta 2
  ENSP ID: ENSP00000397883
  MOD_RES (1)..(1): Any amino acid

SEQ ID NO: 48734 - protein, 227 aa, Homo sapiens; identical to SEQ ID NO: 48723
  Payload ID: 9775
  Gene Symbol: HLA-DQB2
  Gene Name: major histocompatibility complex, class II, DQ beta 2
  Uniprot ID: P05538
  ENSP ID: ENSP00000399594

SEQ ID NO: 48735 - protein, 231 aa, Homo sapiens; identical to SEQ ID NO: 48718
  Payload ID: 9775
  Gene Symbol: HLA-DQB2
  Gene Name: major histocompatibility complex, class II, DQ beta 2
  ENSP ID: ENSP00000400295

SEQ ID NO: 48736 - protein, 218 aa, Homo sapiens; identical to SEQ ID NO: 48730
  Payload ID: 9775
  Gene Symbol: HLA-DQB2
  Gene Name: major histocompatibility complex, class II, DQ beta 2
  ENSP ID: ENSP00000401270
  MOD_RES (1)..(1): Any amino acid

SEQ ID NO: 48737 - protein, 218 aa, Homo sapiens
  Payload ID: 9775
  Gene Symbol: HLA-DQB2
  Gene Name: major histocompatibility complex, class II, DQ beta 2
  ENSP ID: ENSP00000403201
  MOD_RES (1)..(1): Any amino acid
XLQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRLLH

SEQ ID NO: 48738 - protein, 218 aa, Homo sapiens; identical to SEQ ID NO: 48737
  Payload ID: 9775
  Gene Symbol: HLA-DQB2
  Gene Name: major histocompatibility complex, class II, DQ beta 2
  ENSP ID: ENSP00000403893
  MOD_RES (1)..(1): Any amino acid

SEQ ID NO: 48739 - protein, 279 aa, Homo sapiens; identical to SEQ ID NO: 48717
  Payload ID: 9775
  Gene Symbol: HLA-DQB2
  Gene Name: major histocompatibility complex, class II, DQ beta 2
  ENSP ID: ENSP00000406872

SEQ ID NO: 48740 - protein, 231 aa, Homo sapiens; identical to SEQ ID NO: 48718
  Payload ID: 9775
  Gene Symbol: HLA-DQB2
  Gene Name: major histocompatibility complex, class II, DQ beta 2
  ENSP ID: ENSP00000407691

SEQ ID NO: 48741 - protein, 227 aa, Homo sapiens; identical to SEQ ID NO: 48723
  Payload ID: 9775
  Gene Symbol: HLA-DQB2
  Gene Name: major histocompatibility complex, class II, DQ beta 2
  Uniprot ID: P05538
  ENSP ID: ENSP00000408884

SEQ ID NO: 48742 - protein, 275 aa, Homo sapiens; identical to SEQ ID NO: 48720
  Payload ID: 9775
  Gene Symbol: HLA-DQB2
  Gene Name: major histocompatibility complex, class II, DQ beta 2
  ENSP ID: ENSP00000409159

SEQ ID NO: 48743 - protein, 268 aa, Homo sapiens; identical to SEQ ID NO: 48719
  Payload ID: 9775
  Gene Symbol: HLA-DQB2
  Gene Name: major histocompatibility complex, class II, DQ beta 2
  Uniprot ID: P05538
  ENSP ID: ENSP00000410132

SEQ ID NO: 48744 - protein, 275 aa, Homo sapiens; identical to SEQ ID NO: 48720
  Payload ID: 9775
  Gene Symbol: HLA-DQB2
  Gene Name: major histocompatibility complex, class II, DQ beta 2
  ENSP ID: ENSP00000410512

SEQ ID NO: 48745 - protein, 218 aa, Homo sapiens; identical to SEQ ID NO: 48737
  Payload ID: 9775
  Gene Symbol: HLA-DQB2
  Gene Name: major histocompatibility complex, class II, DQ beta 2
  ENSP ID: ENSP00000411739
  MOD_RES (1)..(1): Any amino acid

SEQ ID NO: 48746 - protein, 218 aa, Homo sapiens; identical to SEQ ID NO: 48730
  Payload ID: 9775
  Gene Symbol: HLA-DQB2
  Gene Name: major histocompatibility complex, class II, DQ beta 2
  ENSP ID: ENSP00000414496
  MOD_RES (1)..(1): Any amino acid

SEQ ID NO: 48747 - protein, 218 aa, Homo sapiens; identical to SEQ ID NO: 48737
  Payload ID: 9775
  Gene Symbol: HLA-DQB2
  Gene Name: major histocompatibility complex, class II, DQ beta 2
  ENSP ID: ENSP00000415997
  MOD_RES (1)..(1): Any amino acid

SEQ ID NO: 48748 - protein, 264 aa, Homo sapiens; identical to SEQ ID NO: 48721
  Payload ID: 9775
  Gene Symbol: HLA-DQB2
  Gene Name: major histocompatibility complex, class II, DQ beta 2
  ENSP ID: ENSP00000416466

SEQ ID NO: 48749 - protein, 229 aa, Homo sapiens
  Payload ID: 9776
  Gene Symbol: HLA-DRA
  Gene Name: major histocompatibility complex, class II, DR alpha
  ENSP ID: ENSP00000364121
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGLRKSNAAERRGPL

SEQ ID NO: 48750 - protein, 254 aa, Homo sapiens
  Payload ID: 9776
  Gene Symbol: HLA-DRA
  Gene Name: major histocompatibility complex, class II, DR alpha
  Uniprot ID: P01903
  ENSP ID: ENSP00000372608
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGLRKSNAAERRGPL

SEQ ID NO: 48751 - protein, 229 aa, Homo sapiens
  Payload ID: 9776
  Gene Symbol: HLA-DRA
  Gene Name: major histocompatibility complex, class II, DR alpha
  ENSP ID: ENSP00000372745
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGVRKSNAAERRGPL

SEQ ID NO: 48752 - protein, 254 aa, Homo sapiens
  Payload ID: 9776
  Gene Symbol: HLA-DRA
  Gene Name: major histocompatibility complex, class II, DR alpha
  Uniprot ID: P01903
  ENSP ID: ENSP00000372746
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGVRKSNAAERRGPL

SEQ ID NO: 48753 - protein, 254 aa, Homo sapiens; identical to SEQ ID NO: 48750
  Payload ID: 9776
  Gene Symbol: HLA-DRA
  Gene Name: major histocompatibility complex, class II, DR alpha
  Uniprot ID: P01903
  ENSP ID: ENSP00000378786

SEQ ID NO: 48754 - protein, 229 aa, Homo sapiens; identical to SEQ ID NO: 48751
  Payload ID: 9776
  Gene Symbol: HLA-DRA
  Gene Name: major histocompatibility complex, class II, DR alpha
  ENSP ID: ENSP00000392789

SEQ ID NO: 48755 - protein, 229 aa, Homo sapiens; identical to SEQ ID NO: 48751
  Payload ID: 9776
  Gene Symbol: HLA-DRA
  Gene Name: major histocompatibility complex, class II, DR alpha
  ENSP ID: ENSP00000398838

SEQ ID NO: 48756 - protein, 254 aa, Homo sapiens; identical to SEQ ID NO: 48752
  Payload ID: 9776
  Gene Symbol: HLA-DRA
  Gene Name: major histocompatibility complex, class II, DR alpha
  Uniprot ID: P01903
  ENSP ID: ENSP00000402951

SEQ ID NO: 48757 - protein, 229 aa, Homo sapiens; identical to SEQ ID NO: 48749
  Payload ID: 9776
  Gene Symbol: HLA-DRA
  Gene Name: major histocompatibility complex, class II, DR alpha
  ENSP ID: ENSP00000403385

SEQ ID NO: 48758 - protein, 254 aa, Homo sapiens; identical to SEQ ID NO: 48752
  Payload ID: 9776
  Gene Symbol: HLA-DRA
  Gene Name: major histocompatibility complex, class II, DR alpha
  Uniprot ID: P01903
  ENSP ID: ENSP00000404533

SEQ ID NO: 48759 - protein, 254 aa, Homo sapiens; identical to SEQ ID NO: 48752
  Payload ID: 9776
  Gene Symbol: HLA-DRA
  Gene Name: major histocompatibility complex, class II, DR alpha
  Uniprot ID: P01903
  ENSP ID: ENSP00000405295

SEQ ID NO: 48760 - protein, 254 aa, Homo sapiens; identical to SEQ ID NO: 48752
  Payload ID: 9776
  Gene Symbol: HLA-DRA
  Gene Name: major histocompatibility complex, class II, DR alpha
  Uniprot ID: P01903
  ENSP ID: ENSP00000410443

SEQ ID NO: 48761 - protein, 229 aa, Homo sapiens; identical to SEQ ID NO: 48751
  Payload ID: 9776
  Gene Symbol: HLA-DRA
  Gene Name: major histocompatibility complex, class II, DR alpha
  ENSP ID: ENSP00000411610

SEQ ID NO: 48762 - protein, 229 aa, Homo sapiens; identical to SEQ ID NO: 48751
  Payload ID: 9776
  Gene Symbol: HLA-DRA
  Gene Name: major histocompatibility complex, class II, DR alpha
  ENSP ID: ENSP00000412562

SEQ ID NO: 48763 - protein, 254 aa, Homo sapiens; identical to SEQ ID NO: 48750
  Payload ID: 9776
  Gene Symbol: HLA-DRA
  Gene Name: major histocompatibility complex, class II, DR alpha
  ENSP ID: ENSP00000479287

SEQ ID NO: 48764 - protein, 266 aa, Homo sapiens
  Payload ID: 9777
  Gene Symbol: HLA-DRB1
  Gene Name: major histocompatibility complex, class II, DR beta 1
  Uniprot ID: P01912
  ENSP ID: ENSP00000331343
MVCLRLPGGSCMAVLTVTLMVLSSPLALAGDTRPRFLEYSTSECHFFNGTERVRYLDRYFHNQEENVRFDSDVGEFRAVTELGRPDAEYWNSQKDLLEQKRGRVDNYCRHNYGVVESFTVQRRVHPKVTVYPSKTQPLQHHNLLVCSVSGFYPGSIEVRWFRNGQEEKTGVVSTGLIHNGDWTFQTLVMLETVPRSGEVYTCQVEHPSVTSPLTVEWRARSESAQSKMLSGVGGFVLGLLFLGAGLFIYFRNQKGHSGLQPRGFLS

SEQ ID NO: 48765 - protein, 266 aa, Homo sapiens
  Payload ID: 9777
  Gene Symbol: HLA-DRB1
  Gene Name: major histocompatibility complex, class II, DR beta 1
  Uniprot ID: P04229
  ENSP ID: ENSP00000353099
MVCLKLPGGSCMTALTVTLMVLSSPLALSGDTRPRFLWQPKRECHFFNGTERVRFLDRYFYNQEESVRFDSDVGEFRAVTELGRPDAEYWNSQKDILEQARAAVDTYCRHNYGVVESFTVQRRVQPKVTVYPSKTQPLQHHNLLVCSVSGFYPGSIEVRWFLNGQEEKAGMVSTGLIQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 48766 - protein, 266 aa, Homo sapiens; identical to SEQ ID NO: 48764
  Payload ID: 9777
  Gene Symbol: HLA-DRB1
  Gene Name: major histocompatibility complex, class II, DR beta 1
  Uniprot ID: P01912
  ENSP ID: ENSP00000382378

SEQ ID NO: 48767 - protein, 251 aa, Homo sapiens
  Payload ID: 9777
  Gene Symbol: HLA-DRB1
  Gene Name: major histocompatibility complex, class II, DR beta 1
  Uniprot ID: Q95IE3
  ENSP ID: ENSP00000392280
  MOD_RES (1)..(1): Any amino acid
XLLKLTRDFPQRHEKYQSWAGTFHLCLKKNKYPDSRSTFIKHAGSYLKRGEFLAIHTAITCFFRQISARFLEYSTSECHFFNGTERVRYLDRYFHNQEENVRFDSDVGEFRAVTELGRPDAEYWNSQKDLLEQKRGRVDNYCRHNYGVVESFTVQRRVHPKVTVYPSKTQPLQHHNLLVCSVSGFYPGSIEVRWFRNGQEEKTGVVSTGLIHNGDWTFQTLVMLETVPRSGEVYTCQVEHPSVTSPLTVEW

SEQ ID NO: 48768 - protein, 250 aa, Homo sapiens
  Payload ID: 9777
  Gene Symbol: HLA-DRB1
  Gene Name: major histocompatibility complex, class II, DR beta 1
  ENSP ID: ENSP00000392880
  MOD_RES (1)..(1): Any amino acid
XLLKLTRDFPQRHEKYQSWAGTFHLCLKKNKYPDSRSTFIKHAGSYLKRGEFLSIHTAITCFFLQISARFLWQGKYKCHFFNGTERVQFLERLFYNQEEFVRFDSDVGEYRAVTELGRPVAESWNSQKDILEDRRGQVDTVCRHNYGVGESFTVQRRVHPEVTVYPAKTQPLQHHNLLVCSVSGFYPGSIEVRWFRNGQEEKAGVVSTGLIQNGDWTFQTLVMLETVPRSGEVYTCQVEHPSVMSPLTVE

SEQ ID NO: 48769 - protein, 266 aa, Homo sapiens
  Payload ID: 9777
  Gene Symbol: HLA-DRB1
  Gene Name: major histocompatibility complex, class II, DR beta 1
  Uniprot ID: P13760
  ENSP ID: ENSP00000403458
MVCLKFPGGSCMAALTVTLMVLSSPLALAGDTRPRFLEQVKHECHFFNGTERVRFLDRYFYHQEEYVRFDSDVGEYRAVTELGRPDAEYWNSQKDLLEQRRAEVDTYCRHNYGVVESFTVQRRVYPEVTVYPAKTQPLQHHNLLVCSVNGFYPGSIEVRWFRNGQEEKTGVVSTGLIQNGDWTFQTLVMLETVPRSGEVYTCQVEHPSLTSPLTVEWRARSESAQSKMLSGVGGFVLGLLFLGAGLFIYFRNQKGHSGLQPTGFLS

SEQ ID NO: 48770 - protein, 266 aa, Homo sapiens
  Payload ID: 9777
  Gene Symbol: HLA-DRB1
  Gene Name: major histocompatibility complex, class II, DR beta 1
  Uniprot ID: P13761
  ENSP ID: ENSP00000405960
MVCLKLPGGSCMAALTVTLMVLSSPLALAGDTQPRFLWQGKYKCHFFNGTERVQFLERLFYNQEEFVRFDSDVGEYRAVTELGRPVAESWNSQKDILEDRRGQVDTVCRHNYGVGESFTVQRRVHPEVTVYPAKTQPLQHHNLLVCSVSGFYPGSIEVRWFRNGQEEKAGVVSTGLIQNGDWTFQTLVMLETVPRSGEVYTCQVEHPSVMSPLTVEWRARSESAQSKMLSGVGGFVLGLLFLGAGLFIYFRNQKGHSGLQPTGFLS

SEQ ID NO: 48771 - protein, 250 aa, Homo sapiens
  Payload ID: 9777
  Gene Symbol: HLA-DRB1
  Gene Name: major histocompatibility complex, class II, DR beta 1
  Uniprot ID: Q95IE3
  ENSP ID: ENSP00000408795
LLKLTRDFPQRHEKYQSWAGTFHLCLKKNKYPDSRSTFIKHAGSYLKRGEFLSIHTAITCFFLQISARFLEQVKHECHFFNGTERVRFLDRYFYHQEEYVRFDSDVGEYRAVTELGRPDAEYWNSQKDLLEQRRAEVDTYCRHNYGVVESFTVQRRVYPEVTVYPAKTQPLQHHNLLVCSVNGFYPGSIEVRWFRNGQEEKTGVVSTGLIQNGDWTFQTLVMLETVPRSGEVYTCQVEHPSLTSPLTVEW

SEQ ID NO: 48772 - protein, 266 aa, Homo sapiens; identical to SEQ ID NO: 48770
  Payload ID: 9777
  Gene Symbol: HLA-DRB1
  Gene Name: major histocompatibility complex, class II, DR beta 1
  Uniprot ID: P13761
  ENSP ID: ENSP00000409322

SEQ ID NO: 48773 - protein, 251 aa, Homo sapiens; identical to SEQ ID NO: 48767
  Payload ID: 9777
  Gene Symbol: HLA-DRB1
  Gene Name: major histocompatibility complex, class II, DR beta 1
  Uniprot ID: Q95IE3
  ENSP ID: ENSP00000412168
  MOD_RES (1)..(1): Any amino acid

SEQ ID NO: 48774 - protein, 266 aa, Homo sapiens
  Payload ID: 9777
  Gene Symbol: HLA-DRB1
  Gene Name: major histocompatibility complex, class II, DR beta 1
  ENSP ID: ENSP00000446833
MVCLKFPGGSCMAALTVTLMVLSSPLALAGDTRPRFLEQVKHECHFFNGTERVRFLDRYFYHQEEYVRFDSDVGEYRAVTELGRPDAEYWNSQKDLLEQRRAEVDTYCRHNYGVVESFTVQRRVYPEVTVYPAKTQPLQHHNLLVCSVNGFYPGSIEVRWFRNGQEEKTGVVSTGLIQNGDWTFQTLVMLETVPRSGEVYTCQVEHPSLTSPLTVEWRARSESAQSKMLSGVGGFVLGLLFLGAGLFIYFRNQKGHSGLQPTGLLS

SEQ ID NO: 48775 - protein, 269 aa, Homo sapiens
  Payload ID: 9777
  Gene Symbol: HLA-DRB1
  Gene Name: major histocompatibility complex, class II, DR beta 1
  ENSP ID: ENSP00000447061
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRGEPKVTVYPSKTQPLQHHNLLVCSVSGFYPGSIEVRWFRNGQEEKTGVVSTGLIHNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 48776 - protein, 269 aa, Homo sapiens; identical to SEQ ID NO: 48775
  Payload ID: 9777
  Gene Symbol: HLA-DRB1
  Gene Name: major histocompatibility complex, class II, DR beta 1
  ENSP ID: ENSP00000448427

SEQ ID NO: 48777 - protein, 269 aa, Homo sapiens
  Payload ID: 9777
  Gene Symbol: HLA-DRB1
  Gene Name: major histocompatibility complex, class II, DR beta 1
  ENSP ID: ENSP00000449692
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRGEPEVTVYPAKTQPLQHHNLLVCSVSGFYPGSIEVRWFRNGQEEKAGVVSTGLIQNGDWTFQTLVMLETVPRSGEVYTCQVEHPSVMSPLTVEWRARSESAQSKMLSGVGGFVLGLLFLGAGLFIYFRNQKGHSGLQPTGFLS

SEQ ID NO: 48778 - protein, 269 aa, Homo sapiens
  Payload ID: 9777
  Gene Symbol: HLA-DRB1
  Gene Name: major histocompatibility complex, class II, DR beta 1
  ENSP ID: ENSP00000449952
MSWKKALRIPGGLRVATVTLMLAMLSTPVAEGRDSPEDFVYQFKGMCYFTNGTERVRGVTRYIYNREEYARFDSDVGVYRAVTPLGPPAAEYWNSQKEVLERTRAELDTVCRHNYQLELRTTLQRRGEPEVTVYPAKTQPLQHHNLLVCSVNGFYPGSIEVRWFRNGQEEKTGVVSTGLIQNGDWTFQTLVMLETVPRSGEVYTCQVEHPSLTSPLTVEWRARSESAQSKMLSGVGGFVLGLLFLGAGLFIYFRNQKGHSGLQPTGFLS

SEQ ID NO: 48779 - protein, 266 aa, Homo sapiens; identical to SEQ ID NO: 48764
  Payload ID: 9777
  Gene Symbol: HLA-DRB1
  Gene Name: major histocompatibility complex, class II, DR beta 1
  Uniprot ID: P01912
  ENSP ID: ENSP00000479406

SEQ ID NO: 48780 - protein, 266 aa, Homo sapiens; identical to SEQ ID NO: 48769
  Payload ID: 9777
  Gene Symbol: HLA-DRB1
  Gene Name: major histocompatibility complex, class II, DR beta 1
  ENSP ID: ENSP00000479426

SEQ ID NO: 48781 - protein, 266 aa, Homo sapiens
  Payload ID: 9777
  Gene Symbol: HLA-DRB1
  Gene Name: major histocompatibility complex, class II, DR beta 1
  ENSP ID: ENSP00000479900
MVCLRLPGGSCMAVLTVTLMVLSSPLALAGDTRPRFLEYSTSECHFFNGTERVRYLDRYFHNQEENVRFDSDVGEFRAVTELGRPDAEYWNSQKDLLEQKRGRVDNYCRHNYGVVESFTVQRRVHPKVTVYPSKTQPLQHHNLLVCSVSGFYPGSIEVRWFRNGQEEKTGVVSTGLIHNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 48782 - protein, 266 aa, Homo sapiens
  Payload ID: 9777
  Gene Symbol: HLA-DRB1
  Gene Name: major histocompatibility complex, class II, DR beta 1
  ENSP ID: ENSP00000480667
MVCLKLPGGSCMTALTVTLMVLSSPLALSGDTRPRFLWQPKRECHFFNGTERVRFLDRYFYNQEESVRFDSDVGEFRAVTELGRPDAEYWNSQKDILEQARAAVDTYCRHNYGVVESFTVQRRGEPKVTVYPSKTQPLQHHNLLVCSVSGFYPGSIEVRWFLNGQEEKAGMVSTGLIQNGDWTFQTLVMLETVPRSGEVYTCQVEHPSVTSPLTVEWRARSESAQSKMLSGVGGFVLGLLFLGAGLFIYFRNQKGHSGLQPTGLLS

SEQ ID NO: 48783 - protein, 266 aa, Homo sapiens
  Payload ID: 9777
  Gene Symbol: HLA-DRB1
  Gene Name: major histocompatibility complex, class II, DR beta 1
  ENSP ID: ENSP00000481487
MVCLRLPGGSCMAVLTVTLMVLSSPLALAGDTRPRFLEYSTSECHFFNGTERVRYLDRYFHNQEENVRFDSDVGEFRAVTELGRPDAEYWNSQKDLLEQKRGRVDNYCRHNYGVVESFTVQRRVHPKVTVYPSKTQPLQHHNLLVCSVSGFYPGSIEVRWFRNGQEEKTGVVSTGLIHNGDWTFQTLVMLETVPRSGEVYTCQVEHPSVTSPLTVEWSARSESAQSKMLSGVGGFVLGLLFLGAGLFIYFRNQKGHSGLQPTGFLS

SEQ ID NO: 48784 - protein, 266 aa, Homo sapiens; identical to SEQ ID NO: 48770
  Payload ID: 9777
  Gene Symbol: HLA-DRB1
  Gene Name: major histocompatibility complex, class II, DR beta 1
  Uniprot ID: P13761
  ENSP ID: ENSP00000481636

SEQ ID NO: 48785 - protein, 266 aa, Homo sapiens; identical to SEQ ID NO: 48770
  Payload ID: 9777
  Gene Symbol: HLA-DRB1
  Gene Name: major histocompatibility complex, class II, DR beta 1
  Uniprot ID: P13761
  ENSP ID: ENSP00000482190

SEQ ID NO: 48786 - protein, 266 aa, Homo sapiens
  Payload ID: 9777
  Gene Symbol: HLA-DRB1
  Gene Name: major histocompatibility complex, class II, DR beta 1
  ENSP ID: ENSP00000482266
MVCLKLPGGSCMAALTVTLMVLSSPLALAGDTQPRFLWQGKYKCHFFNGTERVQFLERLFYNQEEFVRFDSDVGEYRAVTELGRPVAESWNSQKDILEDRRGQVDTVCRHNYGVGESFTVQRRVHPEVTVYPAKTQPLQHHNLLVCSVSGFYPGSIEVRWFRNGQEEKAGVVSTGLIQNGDWTFQTLVMLETVPRSGEVYTCQVEHPSVMSPLTVEWRARSESAQSKMLSGVGGFVLGLLFLGAGLFIYFRNQKGHSGLQPTGLLS

SEQ ID NO: 48787 - protein, 266 aa, Homo sapiens; identical to SEQ ID NO: 48786
  Payload ID: 9777
  Gene Symbol: HLA-DRB1
  Gene Name: major histocompatibility complex, class II, DR beta 1
  ENSP ID: ENSP00000482905

SEQ ID NO: 48788 - protein, 269 aa, Homo sapiens
  Payload ID: 9777
  Gene Symbol: HLA-DRB1
  Gene Name: major histocompatibility complex, class II, DR beta 1
  ENSP ID: ENSP00000484131
MSWKKALRIPGGLRVATVTLMLAMLSTPVAEGRDSPEDFVYQFKGMCYFTNGTERVRLVTRYIYNREEYARFDSDVGVYRAVTPLGPPDAEYWNSQKEVLERTRAELDTVCRHNYQLELRTTLQRRGEPEVTVYPAKTQPLQHHNLLVCSVSGFYPGSIEVRWFRNGQEEKAGVVSTGLIQNGDWTFQTLVMLETVPRSGEVYTCQVEHPSVMSPLTVEWRARSESAQSKMLSGVGGFVLGLLFLGAGLFIYFRNQKGHSGLQPTGFLS

SEQ ID NO: 48789 - protein, 266 aa, Homo sapiens; identical to SEQ ID NO: 48769
  Payload ID: 9777
  Gene Symbol: HLA-DRB1
  Gene Name: major histocompatibility complex, class II, DR beta 1
  ENSP ID: ENSP00000484448

SEQ ID NO: 48790 - protein, 266 aa, Homo sapiens; identical to SEQ ID NO: 48764
  Payload ID: 9777
  Gene Symbol: HLA-DRB1
  Gene Name: major histocompatibility complex, class II, DR beta 1
  Uniprot ID: P01912
  ENSP ID: ENSP00000484489

SEQ ID NO: 48791 - protein, 266 aa, Homo sapiens; identical to SEQ ID NO: 48783
  Payload ID: 9777
  Gene Symbol: HLA-DRB1
  Gene Name: major histocompatibility complex, class II, DR beta 1
  ENSP ID: ENSP00000484527

SEQ ID NO: 48792 - protein, 266 aa, Homo sapiens
  Payload ID: 9777
  Gene Symbol: HLA-DRB1
  Gene Name: major histocompatibility complex, class II, DR beta 1
  ENSP ID: ENSP00000484667
MVCLKFPGGSCMAALTVTLMVLSSPLALAGDTRPRFLEQVKHECHFFNGTERVRFLDRYFYHQEEYVRFDSDVGEYRAVTELGRPDAEYWNSQKDLLEQRRAEVDTYCRHNYGVVESFTVQRRGEPEVTVYPAKTQPLQHHNLLVCSVNGFYPGSIEVRWFRNGQEEKTGVVSTGLIQNGDWTFQTLVMLETVPRSGEVYTCQVEHPSLTSPLTVEWRARSESAQSKMLSGVGGFVLGLLFLGAGLFIYFRNQKGHSGLQPTGLLS

SEQ ID NO: 48793 - protein, 266 aa, Homo sapiens
  Payload ID: 9778
  Gene Symbol: HLA-DRB3
  Gene Name: major histocompatibility complex, class II, DR beta 3
  Uniprot ID: P79483
  ENSP ID: ENSP00000302517
MVCLKLPGGSSLAALTVTLMVLSSRLAFAGDTRPRFLELLKSECHFFNGTERVRFLERHFHNQEEYARFDSDVGEYRAVRELGRPDAEYWNSQKDLLEQKRGQVDNYCRHNYGVGESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSPLTVEWSARSESAQSKMLSGVGGFVLGLLFLGAGLFIYFRNQKGHSGLQPTGFLS

SEQ ID NO: 48794 - protein, 266 aa, Homo sapiens
  Payload ID: 9778
  Gene Symbol: HLA-DRB3
  Gene Name: major histocompatibility complex, class II, DR beta 3
  ENSP ID: ENSP00000372607
MVCLKLPGGSSLAALTVTLMVLSSRLAFAGDTRPRFLELRKSECHFFNGTERVRYLDRYFHNQEEFLRFDSDVGEYRAVTELGRPVAESWNSQKDLLEQKRGRVDNYCRHNYGVGESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSALTVEWRARSESAQSKMLSGVGGFVLGLLFLGAGLFIYFRNQKGHSGLQPTGFLS

SEQ ID NO: 48795 - protein, 266 aa, Homo sapiens; identical to SEQ ID NO: 48793
  Payload ID: 9778
  Gene Symbol: HLA-DRB3
  Gene Name: major histocompatibility complex, class II, DR beta 3
  ENSP ID: ENSP00000416022

SEQ ID NO: 48796 - protein, 266 aa, Homo sapiens
  Payload ID: 9778
  Gene Symbol: HLA-DRB3
  Gene Name: major histocompatibility complex, class II, DR beta 3
  ENSP ID: ENSP00000478579
MVCLRLPGGSCMAVLTVTLMVLSSPLALAGDTRPRFLELLKSECHFFNGTERVRFLERHFHNQEEYARFDSDVGEYRAVRELGRPDAEYWNSQKDLLEQKRGQVDNYCRHNYGVGESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSPLTVEWSARSESAQSKMLSGVGGFVLGLLFLGAGLFIYFRNQKGHSGLQPTGFLS

SEQ ID NO: 48797 - protein, 266 aa, Homo sapiens
  Payload ID: 9778
  Gene Symbol: HLA-DRB3
  Gene Name: major histocompatibility complex, class II, DR beta 3
  ENSP ID: ENSP00000479795
MVCLRLPGGSCMAVLTVTLMVLSSPLALAGDTRPRFLEYSTSECHFFNGTERVRYLDRYFHNQEENVRFDSDVGEFRAVTELGRPDAEYWNSQKDLLEQKRGRVDNYCRHNYGVVESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSPLTVEWSARSESAQSKMLSGVGGFVLGLLFLGAGLFIYFRNQKGHSGLQPTGFLS

SEQ ID NO: 48798 - protein, 266 aa, Homo sapiens
  Payload ID: 9778
  Gene Symbol: HLA-DRB3
  Gene Name: major histocompatibility complex, class II, DR beta 3
  ENSP ID: ENSP00000480138
MVCLRLPGGSCMAVLTVTLMVLSSPLALAGDTRPRFLEYSTSECHFFNGTERVRYLDRYFHNQEENVRFDSDVGEFRAVTELGRPDAEYWNSQKDLLEQKRGRVDNYCRHNYGVVESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSALTVEWRARSESAQSKMLSGVGGFVLGLLFLGAGLFIYFRNQKGHSGLQPTGFLS

SEQ ID NO: 48799 - protein, 266 aa, Homo sapiens
  Payload ID: 9778
  Gene Symbol: HLA-DRB3
  Gene Name: major histocompatibility complex, class II, DR beta 3
  ENSP ID: ENSP00000482007
MVCLRLPGGSCMAVLTVTLMVLSSPLALAGDTRPRFLEYSTSECHFFNGTERVRYLDRYFHNQEENVRFDSDVGEYRAVRELGRPDAEYWNSQKDLLEQKRGQVDNYCRHNYGVGESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSPLTVEWSARSESAQSKMLSGVGGFVLGLLFLGAGLFIYFRNQKGHSGLQPTGFLS

SEQ ID NO: 48800 - protein, 266 aa, Homo sapiens
  Payload ID: 9778
  Gene Symbol: HLA-DRB3
  Gene Name: major histocompatibility complex, class II, DR beta 3
  ENSP ID: ENSP00000483060
MVCLRLPGGSCMAVLTVTLMVLSSPLALAGDTRPRFLELRKSECHFFNGTERVRYLDRYFHNQEEFLRFDSDVGEYRAVTELGRPVAESWNSQKDLLEQKRGRVDNYCRHNYGVGESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSALTVEWRARSESAQSKMLSGVGGFVLGLLFLGAGLFIYFRNQKGHSGLQPTGFLS

SEQ ID NO: 48801 - protein, 266 aa, Homo sapiens
  Payload ID: 9779
  Gene Symbol: HLA-DRB4
  Gene Name: major histocompatibility complex, class II, DR beta 4
  ENSP ID: ENSP00000410046
MVCLKLPGGSCMAALTVTLTVLSSPLALAGDTQPRFLEQAKCECHFLNGTERVWNLIRYIYNQEEYARYNSDLGEYQAVTELGRPDAEYWNSQKDLLERRRAEVDTYCRYNYGVVESFTVQRRVQPKVTVYPSKTQPLQHHNLLVCSVNGFYPGSIEVRWFRNSQEEKAGVVSTGLIQNGDWTFQTLVMLETVPRSGEVYTCQVEHPSMMSPLTVQWSARSESAQSKMLSGVGGFVLGLLFLGTGLFIYFRNQKGHSGLQPTGLLS

SEQ ID NO: 48802 - protein, 266 aa, Homo sapiens; identical to SEQ ID NO: 38711
  Payload ID: 9779
  Gene Symbol: HLA-DRB4
  Gene Name: major histocompatibility complex, class II, DR beta 4
  Uniprot ID: P13762
  ENSP ID: ENSP00000410857

SEQ ID NO: 48803 - protein, 263 aa, Homo sapiens
  Payload ID: 9779
  Gene Symbol: HLA-DRB4
  Gene Name: major histocompatibility complex, class II, DR beta 4
  ENSP ID: ENSP00000477914
MVCLKLPGGSCMAALTVTLMVLSSPLALAGDTQPRFLEQAKSECHFFNGTERYLRYFYNQEEYVRFNSDMGEFRAVTELGRPDAEYWNSQKDLLERRRAEVDTYCRYNYGVVESFTVQRRVQPKVTVYPSKTQPLQHHNLLVCSVNGFYPGSIEVRWFRNSQEEKAGVVSTGLIQNGDWTFQTLVMLETVPRSGEVYTCQVEHPSMMSPLTVQWSARSESAQSKMLSGVGGFVLGLLFLGTGLFIYFRNQKGHSGLQPTGLLS

SEQ ID NO: 48804 - protein, 266 aa, Homo sapiens
  Payload ID: 9779
  Gene Symbol: HLA-DRB4
  Gene Name: major histocompatibility complex, class II, DR beta 4
  ENSP ID: ENSP00000478963
MVCLKLPGGSCMAALTVTLMVLSSPLALAGDTQPRFLWQGKYKCHFFNGTERVQFLERLFYNQEEFVRFDSDVGEYRAVTELGRPDAEYWNSQKDLLERRRAEVDTYCRYNYGVVESFTVQRRGEPKVTVYPSKTQPLQHHNLLVCSVNGFYPGSIEVRWFRNSQEEKAGVVSTGLIQNGDWTFQTLVMLETVPRSGEVYTCQVEHPSMMSPLTVQWSARSESAQSKMLSGVGGFVLGLLFLGTGLFIYFRNQKGHSGLQPTGLLS

SEQ ID NO: 48805 - protein, 266 aa, Homo sapiens
  Payload ID: 9780
  Gene Symbol: HLA-DRB5
  Gene Name: major histocompatibility complex, class II, DR beta 5
  Uniprot ID: Q30154
  ENSP ID: ENSP00000364114
MVCLKLPGGSYMAKLTVTLMVLSSPLALAGDTRPRFLQQDKYECHFFNGTERVRFLHRDIYNQEEDLRFDSDVGEYRAVTELGRPDAEYWNSQKDFLEDRRAAVDTYCRHNYGVGESFTVQRRVEPKVTVYPARTQTLQHHNLLVCSVNGFYPGSIEVRWFRNSQEEKAGVVSTGLIQNGDWTFQTLVMLETVPRSGEVYTCQVEHPSVTSPLTVEWRAQSESAQSKMLSGVGGFVLGLLFLGAGLFIYFKNQKGHSGLHPTGLVS

SEQ ID NO: 48806 - protein, 249 aa, Homo sapiens
  Payload ID: 9781
  Gene Symbol: MR1
  Gene Name: major histocompatibility complex, class I-related
  Uniprot ID: Q95460
  ENSP ID: ENSP00000282990
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTESETIPLVMKAVSGSIVLVIVLAGVGVLVWRRRPREQNGAIYLPTPDR

SEQ ID NO: 48807 - protein, 296 aa, Homo sapiens
  Payload ID: 9781
  Gene Symbol: MR1
  Gene Name: major histocompatibility complex, class I-related
  Uniprot ID: Q95460
  ENSP ID: ENSP00000356551
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 48808 - protein, 341 aa, Homo sapiens
  Payload ID: 9781
  Gene Symbol: MR1
  Gene Name: major histocompatibility complex, class I-related
  Uniprot ID: Q95460
  ENSP ID: ENSP00000356552
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 48809 - protein, 214 aa, Homo sapiens
  Payload ID: 9781
  Gene Symbol: MR1
  Gene Name: major histocompatibility complex, class I-related
  Uniprot ID: Q95460
  ENSP ID: ENSP00000388504
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEQNGAIYLPTPDR

SEQ ID NO: 48810 - protein, 341 aa, Homo sapiens; identical to SEQ ID NO: 48808
  Payload ID: 9781
  Gene Symbol: MR1
  Gene Name: major histocompatibility complex, class I-related
  Uniprot ID: Q95460
  ENSP ID: ENSP00000477563

SEQ ID NO: 48811 - protein, 249 aa, Homo sapiens; identical to SEQ ID NO: 48806
  Payload ID: 9781
  Gene Symbol: MR1
  Gene Name: major histocompatibility complex, class I-related
  Uniprot ID: Q95460
  ENSP ID: ENSP00000478976

SEQ ID NO: 48812 - protein, 263 aa, Homo sapiens
  Payload ID: 9782
  Gene Symbol: MIP
  Gene Name: major intrinsic protein of lens fiber
  Uniprot ID: P30301
  ENSP ID: ENSP00000257979
MWELRSASFWRAIFAEFFATLFYVFFGLGSSLRWAPGPLHVLQVAMAFGLALATLVQSVGHISGAHVNPAVTFAFLVGSQMSLLRAFCYMAAQLLGAVAGAAVLYSVTPPAVRGNLALNTLHPAVSVGQATTVEIFLTLQFVLCIFATYDERRNGQLGSVALAVGFSLALGHLFGMYYTGAGMNPARSFAPAILTGNFTNHWVYWVGPIIGGGLGSLLYDFLLFPRLKSISERLSVLKGAKPDVSNGQPEVTGEPVELNTQAL

SEQ ID NO: 48813 - protein, 893 aa, Homo sapiens
  Payload ID: 9783
  Gene Symbol: MVP
  Gene Name: major vault protein
  Uniprot ID: Q14764
  ENSP ID: ENSP00000349977
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 48814 - protein, 893 aa, Homo sapiens; identical to SEQ ID NO: 48813
  Payload ID: 9783
  Gene Symbol: MVP
  Gene Name: major vault protein
  Uniprot ID: Q14764
  ENSP ID: ENSP00000378760

SEQ ID NO: 48815 - protein, 42 aa, Homo sapiens
  Payload ID: 9783
  Gene Symbol: MVP
  Gene Name: major vault protein
  ENSP ID: ENSP00000454819
MATEEFIIRIPPYHYIHVLDQNSNVSRVEVGPKTYIRQDNER

SEQ ID NO: 48816 - protein, 144 aa, Homo sapiens
  Payload ID: 9783
  Gene Symbol: MVP
  Gene Name: major vault protein
  ENSP ID: ENSP00000454825
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKAIPLDENEGIYVQDVKTGKVRAVIGSTYMLTQDEVLW

SEQ ID NO: 48817 - protein, 94 aa, Homo sapiens
  Payload ID: 9783
  Gene Symbol: MVP
  Gene Name: major vault protein
  ENSP ID: ENSP00000455186
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQ

SEQ ID NO: 48818 - protein, 39 aa, Homo sapiens
  Payload ID: 9783
  Gene Symbol: MVP
  Gene Name: major vault protein
  ENSP ID: ENSP00000455532
MATEEFIIRIPPYHYIHVLDQNSNVSRVECPAALGRSGW

SEQ ID NO: 48819 - protein, 81 aa, Homo sapiens
  Payload ID: 9783
  Gene Symbol: MVP
  Gene Name: major vault protein
  ENSP ID: ENSP00000455741
MATEEFIIRIPPYHYIHVLDQNSNVSRVEVGPKTYIRQDNERFWIWWTPSSLRKRQPCTSGLGGTSGTSGECPAALGRSGW

SEQ ID NO: 48820 - protein, 220 aa, Homo sapiens
  Payload ID: 9783
  Gene Symbol: MVP
  Gene Name: major vault protein
  ENSP ID: ENSP00000455819
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVI

SEQ ID NO: 48821 - protein, 148 aa, Homo sapiens
  Payload ID: 9783
  Gene Symbol: MVP
  Gene Name: major vault protein
  ENSP ID: ENSP00000456291
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGP

SEQ ID NO: 48822 - protein, 107 aa, Homo sapiens
  Payload ID: 9783
  Gene Symbol: MVP
  Gene Name: major vault protein
  ENSP ID: ENSP00000457685
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEK

SEQ ID NO: 48823 - protein, 57 aa, Homo sapiens
  Payload ID: 9783
  Gene Symbol: MVP
  Gene Name: major vault protein
  ENSP ID: ENSP00000457734
MATEEFIIRIPPYHYIHVLDQNSNVSRVEVGPKTYIRQDNERTSHPCRWFCPTLPSI

SEQ ID NO: 48824 - protein, 61 aa, Homo sapiens
  Payload ID: 9783
  Gene Symbol: MVP
  Gene Name: major vault protein
  ENSP ID: ENSP00000458583
  MOD_RES (1)..(1): Any amino acid
XGDEWLFEGPGTYIPRKEVEVVEIIQATIIRQNQALRLRARKECWDRDGKERVTGGVTKGR

SEQ ID NO: 48825 - protein, 39 aa, Homo sapiens; identical to SEQ ID NO: 48818
  Payload ID: 9783
  Gene Symbol: MVP
  Gene Name: major vault protein
  ENSP ID: ENSP00000486166

SEQ ID NO: 48826 - protein, 300 aa, Homo sapiens
  Payload ID: 9784
  Gene Symbol: MAK16
  Gene Name: MAK16 homolog
  Uniprot ID: Q9BXY0
  ENSP ID: ENSP00000353246
MQSDDVIWDTLGNKQFCSFKIRTKTQSFCRNEYSLTGLCNRSSCPLANSQYATIKEEKGQCYLYMKVIERAAFPRRLWERVRLSKNYEKALEQIDENLIYWPRFIRHKCKQRFTKITQYLIRIRKLTLKRQRKLVPLSKKVERREKRREEKALIAAQLDNAIEKELLERLKQDTYGDIYNFPIHAFDKALEQQEAESDSSDTEEKDDDDDDEEDVGKREFVEDGEVDESDISDFEDMDKLDASSDEDQDGKSSSEEEEEKALSAKHKGKMPLRGPLQRKRAYVEIEYEQETEPVAKAKTT

SEQ ID NO: 48827 - protein, 137 aa, Homo sapiens
  Payload ID: 9784
  Gene Symbol: MAK16
  Gene Name: MAK16 homolog
  ENSP ID: ENSP00000430403
  MOD_RES (1)..(1): Any amino acid
XDTMQSDDVIWDTLGNKQFCSFKIRTKTQSFCRNEYSLTGLCNRSSCPLANSQYATIKEEKGQCYLYMKVIERAAFPRRLWERVRLSKNYEKALEQIDENLIYWPRFIRHKCKQRFTKITQYLIRIRKLTLKRQKRH

SEQ ID NO: 48828 - protein, 482 aa, Homo sapiens
  Payload ID: 9785
  Gene Symbol: MKRN1
  Gene Name: makorin ring finger protein 1
  Uniprot ID: Q9UHC7
  ENSP ID: ENSP00000255977
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIKSCPECRITSNFVIPSEYWVEEKEEKQKLILKYKEAMSNKACRYFDEGRGSCPFGGNCFYKHAYPDGRREEPQRQKVGTSSRYRAQRRNHFWELIEERENSNPFDNDEEEVVTFELGEMLLMLLAAGGDDELTDSEDEWDLFHDELEDFYDLDL

SEQ ID NO: 48829 - protein, 329 aa, Homo sapiens
  Payload ID: 9785
  Gene Symbol: MKRN1
  Gene Name: makorin ring finger protein 1
  Uniprot ID: Q9UHC7
  ENSP ID: ENSP00000416369
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIK

SEQ ID NO: 48830 - protein, 112 aa, Homo sapiens
  Payload ID: 9785
  Gene Symbol: MKRN1
  Gene Name: makorin ring finger protein 1
  ENSP ID: ENSP00000417346
LFPRSCPECRITSNFVIPTTRRAGILMKDVGAAHLEGTVFTSMRTLMAVERSHRDRKWEHQADTGPNEGTTSGNSLRKERTATPLTTMKKRLSPLSWARCCLCFWLQVGTTN

SEQ ID NO: 48831 - protein, 175 aa, Homo sapiens
  Payload ID: 9785
  Gene Symbol: MKRN1
  Gene Name: makorin ring finger protein 1
  ENSP ID: ENSP00000417640
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCSRALRPMRRTWSSHLPCSAARTWCVGSAWRWSMRKPTPVSAASGSSPTATTPTVSSAFASGGVLSNLRARS

SEQ ID NO: 48832 - protein, 418 aa, Homo sapiens
  Payload ID: 9785
  Gene Symbol: MKRN1
  Gene Name: makorin ring finger protein 1
  Uniprot ID: Q9UHC7
  ENSP ID: ENSP00000417863
MHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIKSCPECRITSNFVIPSEYWVEEKEEKQKLILKYKEAMSNKACRYFDEGRGSCPFGGNCFYKHAYPDGRREEPQRQKVGTSSRYRAQRRNHFWELIEERENSNPFDNDEEEVVTFELGEMLLMLLAAGGDDELTDSEDEWDLFHDELEDFYDLDL

SEQ ID NO: 48833 - protein, 93 aa, Homo sapiens
  Payload ID: 9785
  Gene Symbol: MKRN1
  Gene Name: makorin ring finger protein 1
  ENSP ID: ENSP00000417907
MAEAATPGTTATTSGAGAAAATAAAASPTPIPTVTAPSLGAGGGGGGSDGSGGGWTKQVTCRRSLSGVILVHCNLWAPPNPLRVQAILPQPPK

SEQ ID NO: 48834 - protein, 165 aa, Homo sapiens
  Payload ID: 9785
  Gene Symbol: MKRN1
  Gene Name: makorin ring finger protein 1
  ENSP ID: ENSP00000418588
MHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCV

SEQ ID NO: 48835 - protein, 102 aa, Homo sapiens
  Payload ID: 9785
  Gene Symbol: MKRN1
  Gene Name: makorin ring finger protein 1
  ENSP ID: ENSP00000418620
MAQVFTEGKLNLGYFMHGVCKEGDNCRYSHDLSDSPYSVVCKYFQRGYCIYGDRCRYEHSKPLKQEEATATELTTKSSLAASSSLSSIVGPLVEMNTGEAES

SEQ ID NO: 48836 - protein, 193 aa, Homo sapiens
  Payload ID: 9785
  Gene Symbol: MKRN1
  Gene Name: makorin ring finger protein 1
  ENSP ID: ENSP00000418864
MHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIK

SEQ ID NO: 48837 - protein, 39 aa, Homo sapiens
  Payload ID: 9785
  Gene Symbol: MKRN1
  Gene Name: makorin ring finger protein 1
  ENSP ID: ENSP00000419259
WTKQVTCRRSLSGVILVHCNLWAPPNPLRVQAILPQPPK

SEQ ID NO: 48838 - protein, 108 aa, Homo sapiens
  Payload ID: 9785
  Gene Symbol: MKRN1
  Gene Name: makorin ring finger protein 1
  ENSP ID: ENSP00000419695
MAEAATPGTTATTSGAGAAAATAAAASPTPIPTVTAPSLGAGGGGGGSDGSGGGWTKQVTCRWSLCRPSWSAVARSRLTTTSASWVQGILVPQPSEKLGLQVFYAWGL

SEQ ID NO: 48839 - protein, 136 aa, Homo sapiens
  Payload ID: 9785
  Gene Symbol: MKRN1
  Gene Name: makorin ring finger protein 1
  ENSP ID: ENSP00000419843
MHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEES

SEQ ID NO: 48840 - protein, 111 aa, Homo sapiens
  Payload ID: 9785
  Gene Symbol: MKRN1
  Gene Name: makorin ring finger protein 1
  ENSP ID: ENSP00000419894
MHGVCKEGDNCRYSHDLSDSPYSVVCKYFQRGYCIYGDRCSRALRPMRRTWSSHLPCSAARTWCVGSAWRWSMRKPTPVSAASGSSPTATTPTVSSAFASGGVLSNLRARS

SEQ ID NO: 48841 - protein, 416 aa, Homo sapiens
  Payload ID: 9786
  Gene Symbol: MKRN2
  Gene Name: makorin ring finger protein 2
  Uniprot ID: Q9H000
  ENSP ID: ENSP00000170447
MSTKQITCRYFMHGVCREGSQCLFSHDLANSKPSTICKYYQKGYCAYGTRCRYDHTRPSAAAGGAVGTMAHSVPSPAFHSPHPPSEVTASIVKTNSHEPGKREKRTLVLRDRNLSGMAERKTQPSMVSNPGSCSDPQPSPEMKPHSYLDAIRSGLDDVEASSSYSNEQQLCPYAAAGECRFGDACVYLHGEVCEICRLQVLHPFDPEQRKAHEKICMLTFEHEMEKAFAFQASQDKVCSICMEVILEKASASERRFGILSNCNHTYCLSCIRQWRCAKQFENPIIKSCPECRVISEFVIPSVYWVEDQNKKNELIEAFKQGMGKKACKYFEQGKGTCPFGSKCLYRHAYPDGRLAEPEKPRKQLSSQGTVRFFNSVRLWDFIENRESRHVPNNEDVDMTELGDLFMHLSGVESSEP

SEQ ID NO: 48842 - protein, 373 aa, Homo sapiens
  Payload ID: 9786
  Gene Symbol: MKRN2
  Gene Name: makorin ring finger protein 2
  Uniprot ID: Q9H000
  ENSP ID: ENSP00000396340
MSTKQITCRYDHTRPSAAAGGAVGTMAHSVPSPAFHSPHPPSEVTASIVKTNSHEPGKREKRTLVLRDRNLSGMAERKTQPSMVSNPGSCSDPQPSPEMKPHSYLDAIRSGLDDVEASSSYSNEQQLCPYAAAGECRFGDACVYLHGEVCEICRLQVLHPFDPEQRKAHEKICMLTFEHEMEKAFAFQASQDKVCSICMEVILEKASASERRFGILSNCNHTYCLSCIRQWRCAKQFENPIIKSCPECRVISEFVIPSVYWVEDQNKKNELIEAFKQGMGKKACKYFEQGKGTCPFGSKCLYRHAYPDGRLAEPEKPRKQLSSQGTVRFFNSVRLWDFIENRESRHVPNNEDVDMTELGDLFMHLSGVESSEP

SEQ ID NO: 48843 - protein, 414 aa, Homo sapiens
  Payload ID: 9786
  Gene Symbol: MKRN2
  Gene Name: makorin ring finger protein 2
  ENSP ID: ENSP00000397983
MSTKQITCRYFMHGVCREGSQCLFSHDLANSKPSTICKYYQKGYCAYGTRYDHTRPSAAAGGAVGTMAHSVPSPAFHSPHPPSEVTASIVKTNSHEPGKREKRTLVLRDRNLSGMAERKTQPSMVSNPGSCSDPQPSPEMKPHSYLDAIRSGLDDVEASSSYSNEQQLCPYAAAGECRFGDACVYLHGEVCEICRLQVLHPFDPEQRKAHEKICMLTFEHEMEKAFAFQASQDKVCSICMEVILEKASASERRFGILSNCNHTYCLSCIRQWRCAKQFENPIIKSCPECRVISEFVIPSVYWVEDQNKKNELIEAFKQGMGKKACKYFEQGKGTCPFGSKCLYRHAYPDGRLAEPEKPRKQLSSQGTVRFFNSVRLWDFIENRESRHVPNNEDVDMTELGDLFMHLSGVESSEP

SEQ ID NO: 48844 - protein, 507 aa, Homo sapiens
  Payload ID: 9787
  Gene Symbol: MKRN3
  Gene Name: makorin ring finger protein 3
  Uniprot ID: Q13064
  ENSP ID: ENSP00000313881
MEEPAAPSEAHEAAGAQAGAEAAREGVSGPDLPVCEPSGESAAPDSALPHAARGWAPFPVAPVPAHLRRGGLRPAPASGGGAWPSPLPSRSSGIWTKQIICRYYIHGQCKEGENCRYSHDLSGRKMATEGGVSPPGASAGGGPSTAAHIEPPTQEVAEAPPAASSLSLPVIGSAAERGFFEAERDNADRGAAGGAGVESWADAIEFVPGQPYRGRWVASAPEAPLQSSETERKQMAVGSGLRFCYYASRGVCFRGESCMYLHGDICDMCGLQTLHPMDAAQREEHMRACIEAHEKDMELSFAVQRGMDKVCGICMEVVYEKANPNDRRFGILSNCNHSFCIRCIRRWRSARQFENRIVKSCPQCRVTSELVIPSEFWVEEEEEKQKLIQQYKEAMSNKACRYFAEGRGNCPFGDTCFYKHEYPEGWGDEPPGPGGGSFSAYWHQLVEPVRMGEGNMLYKSIKKELVVLRLASLLFKRFLSLRDELPFSEDQWDLLHYELEEYFNLIL

SEQ ID NO: 48845 - protein, 182 aa, Homo sapiens
  Payload ID: 9787
  Gene Symbol: MKRN3
  Gene Name: makorin ring finger protein 3
  ENSP ID: ENSP00000455368
MEEPAAPSEAHEAAGAQAGAEAAREGVSGPDLPVCEPSGESAAPDSALPHAARGWAPFPVAPVPAHLRRGGLRPAPASGGGAWPSPLPSRSSGIWTKQIICRCIRRWRSARQFENRIVKSCPQCRVTSELVIPSEFWVEEEEEKQKLIQQYKEAMSNKACRFTAVKNLPGVSDETLDFGLLS

SEQ ID NO: 48846 - protein, 105 aa, Homo sapiens
  Payload ID: 9787
  Gene Symbol: MKRN3
  Gene Name: makorin ring finger protein 3
  ENSP ID: ENSP00000456779
MEEPAAPSEAHEAAGAQAGAEAAREGVSGPDLPVCEPSGESAAPDSALPHAARGWAPFPVAPVPAHLRRGGLRPAPASGGGAWPSPLPSRSSGIWTKQIICRDIC

SEQ ID NO: 48847 - protein, 28 aa, Homo sapiens
  Payload ID: 9787
  Gene Symbol: MKRN3
  Gene Name: makorin ring finger protein 3
  ENSP ID: ENSP00000457884
MEEPAAPSEAHEAAGAQVYPQVEKCQTV

SEQ ID NO: 48848 - protein, 97 aa, Homo sapiens
  Payload ID: 9788
  Gene Symbol: MAL
  Gene Name: mal, T-cell differentiation protein
  Uniprot ID: P21145
  ENSP ID: ENSP00000304924
MAPAAATGGSTLPSGFSVFTTLPDLLFIFEFDAAYHCTAALFYLSASVLEALATITMQDGFTYRHYHENIAAVVFSYIATLLYVVHAVFSLIRWKSS

SEQ ID NO: 48849 - protein, 111 aa, Homo sapiens
  Payload ID: 9788
  Gene Symbol: MAL
  Gene Name: mal, T-cell differentiation protein
  Uniprot ID: P21145
  ENSP ID: ENSP00000306568
MAPAAATGGSTLPSGFSVFTTLPDLLFIFEFIFGGLVWILVASSLVPWPLVQGWVMFVSVFCFVATTTLIILYIIGAHGGETSWVTLVFSYIATLLYVVHAVFSLIRWKSS

SEQ ID NO: 48850 - protein, 153 aa, Homo sapiens
  Payload ID: 9788
  Gene Symbol: MAL
  Gene Name: mal, T-cell differentiation protein
  Uniprot ID: P21145
  ENSP ID: ENSP00000310880
MAPAAATGGSTLPSGFSVFTTLPDLLFIFEFIFGGLVWILVASSLVPWPLVQGWVMFVSVFCFVATTTLIILYIIGAHGGETSWVTLDAAYHCTAALFYLSASVLEALATITMQDGFTYRHYHENIAAVVFSYIATLLYVVHAVFSLIRWKSS

SEQ ID NO: 48851 - protein, 55 aa, Homo sapiens
  Payload ID: 9788
  Gene Symbol: MAL
  Gene Name: mal, T-cell differentiation protein
  Uniprot ID: P21145
  ENSP ID: ENSP00000322860
MAPAAATGGSTLPSGFSVFTTLPDLLFIFEFVFSYIATLLYVVHAVFSLIRWKSS

SEQ ID NO: 48852 - protein, 176 aa, Homo sapiens
  Payload ID: 9789
  Gene Symbol: MAL2
  Gene Name: mal, T-cell differentiation protein 2 (gene/pseudogene)
  Uniprot ID: Q969L2
  ENSP ID: ENSP00000479708
MSAGGASVPPPPNPAVSFPPPRVTLPAGPDILRTYSGAFVCLEILFGGLVWILVASSNVPLPLLQGWVMFVSVTAFFFSLLFLGMFLSGMVAQIDANWNFLDFAYHFTVFVFYFGAFLLEAAATSLHDLHCNTTITGQPLLSDNQYNINVAASIFAFMTTACYGCSLGLALRRWRP

SEQ ID NO: 48853 - protein, 108 aa, Homo sapiens
  Payload ID: 9789
  Gene Symbol: MAL2
  Gene Name: mal, T-cell differentiation protein 2 (gene/pseudogene)
  ENSP ID: ENSP00000482729
MFVSVTAFFFSLLFLGMFLSGMVAQIDANWNFLDFAYHFTVFVFYFGAFLLEAAATSLHDLHCNTTITGQPLLSDNQYNINVAASIFAFMTTACYGCSLGLALRRWRP

SEQ ID NO: 48854 - protein, 108 aa, Homo sapiens; identical to SEQ ID NO: 48853
  Payload ID: 9789
  Gene Symbol: MAL2
  Gene Name: mal, T-cell differentiation protein 2 (gene/pseudogene)
  ENSP ID: ENSP00000483044

SEQ ID NO: 48855 - protein, 108 aa, Homo sapiens; identical to SEQ ID NO: 48853
  Payload ID: 9789
  Gene Symbol: MAL2
  Gene Name: mal, T-cell differentiation protein 2 (gene/pseudogene)
  ENSP ID: ENSP00000484544

SEQ ID NO: 48856 - protein, 153 aa, Homo sapiens
  Payload ID: 9790
  Gene Symbol: MALL
  Gene Name: mal, T-cell differentiation protein-like
  Uniprot ID: Q13021
  ENSP ID: ENSP00000272462
MASPDPPATSYAPSDVPSGVALFLTIPFAFFLPELIFGFLVWTMVAATHIVYPLLQGWVMYVSLTSFLISLMFLLSYLFGFYKRFESWRVLDSLYHGTTGILYMSAAVLQVHATIVSEKLLDPRIYYINSAASFFAFIATLLYILHAFSIYYH

SEQ ID NO: 48857 - protein, 120 aa, Homo sapiens
  Payload ID: 9790
  Gene Symbol: MALL
  Gene Name: mal, T-cell differentiation protein-like
  ENSP ID: ENSP00000394792
MASPDPPATSYAPSDVPSGVALFLTIPFAFFLPELGIITQAASVSEPQCVIPAPAAAPLPPMRGFQLLCADIWVLGLDHGSRHPHSIPLAARMGDVCLAHLVSHLLDVPVVLLVWILQKI

SEQ ID NO: 48858 - protein, 55 aa, Homo sapiens
  Payload ID: 9790
  Gene Symbol: MALL
  Gene Name: mal, T-cell differentiation protein-like
  ENSP ID: ENSP00000400518
MASPDPPATSYAPSDVPSGVALFLTIPFAFFLPELFFAFIATLLYILHAFSIYYH

SEQ ID NO: 48859 - protein, 334 aa, Homo sapiens
  Payload ID: 9791
  Gene Symbol: MDH1
  Gene Name: malate dehydrogenase 1, NAD (soluble)
  Uniprot ID: P40925
  ENSP ID: ENSP00000233114
MSEPIRVLVTGAAGQIAYSLLYSIGNGSVFGKDQPIILVLLDITPMMGVLDGVLMELQDCALPLLKDVIATDKEDVAFKDLDVAILVGSMPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 48860 - protein, 210 aa, Homo sapiens
  Payload ID: 9791
  Gene Symbol: MDH1
  Gene Name: malate dehydrogenase 1, NAD (soluble)
  ENSP ID: ENSP00000386719
MVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 48861 - protein, 169 aa, Homo sapiens
  Payload ID: 9791
  Gene Symbol: MDH1
  Gene Name: malate dehydrogenase 1, NAD (soluble)
  ENSP ID: ENSP00000386743
MIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 48862 - protein, 119 aa, Homo sapiens
  Payload ID: 9791
  Gene Symbol: MDH1
  Gene Name: malate dehydrogenase 1, NAD (soluble)
  ENSP ID: ENSP00000394504
MMGVLDGVLMELQDCALPLLKDVIATDKEDVAFKDLDVAILVGSMPRREGMERKDLLKANVKIFKSQGAALDKYAKKSVKVIVVGNPANTNCLTASKSAPSIPKENFSCLTRLDHNRAK

SEQ ID NO: 48863 - protein, 67 aa, Homo sapiens
  Payload ID: 9791
  Gene Symbol: MDH1
  Gene Name: malate dehydrogenase 1, NAD (soluble)
  ENSP ID: ENSP00000399004
MQSEPIRVLVTGAAGQIAYSLLYSIGNGSVFGKDQPIILVLLDITPMMGVLDGVLMELQDCALPLLK

SEQ ID NO: 48864 - protein, 87 aa, Homo sapiens
  Payload ID: 9791
  Gene Symbol: MDH1
  Gene Name: malate dehydrogenase 1, NAD (soluble)
  ENSP ID: ENSP00000400937
MRRCSYFPKDVTVFDKDDKSEPIRVLVTGAAGQIAYSLLYSIGNGSVFGKDQMSSQQIKKTLPSKTWMWPFLWAPCQEGKAWREKIY

SEQ ID NO: 48865 - protein, 114 aa, Homo sapiens
  Payload ID: 9791
  Gene Symbol: MDH1
  Gene Name: malate dehydrogenase 1, NAD (soluble)
  ENSP ID: ENSP00000409027
MQSEPIRVLVTGAAGQIAYSLLYSIGNGSVFGKDQPIILVLLDITPMMGVLDGVLMELQDCALPLLKDVIATDKEDVAFKDLDVAILVGSMPRREGMERKDLLKANVKIFKSQG

SEQ ID NO: 48866 - protein, 222 aa, Homo sapiens
  Payload ID: 9791
  Gene Symbol: MDH1
  Gene Name: malate dehydrogenase 1, NAD (soluble)
  ENSP ID: ENSP00000410073
MRRCSYFPKDVTVFDKDDKSEPIRVLVTGAAGQIAYSLLYSIGNGSVFGKDQPIILVLLDITPMMGVLDGVLMELQDCALPLLKDVIATDKEDVAFKDLDVAILVGSMPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQG

SEQ ID NO: 48867 - protein, 352 aa, Homo sapiens
  Payload ID: 9791
  Gene Symbol: MDH1
  Gene Name: malate dehydrogenase 1, NAD (soluble)
  Uniprot ID: P40925
  ENSP ID: ENSP00000438144
MRRCSYFPKDVTVFDKDDKSEPIRVLVTGAAGQIAYSLLYSIGNGSVFGKDQPIILVLLDITPMMGVLDGVLMELQDCALPLLKDVIATDKEDVAFKDLDVAILVGSMPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 48868 - protein, 245 aa, Homo sapiens
  Payload ID: 9791
  Gene Symbol: MDH1
  Gene Name: malate dehydrogenase 1, NAD (soluble)
  Uniprot ID: P40925
  ENSP ID: ENSP00000446395
MPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 48869 - protein, 518 aa, Homo sapiens
  Payload ID: 9792
  Gene Symbol: MDH1B
  Gene Name: malate dehydrogenase 1B, NAD (soluble)
  Uniprot ID: Q5I0G3
  ENSP ID: ENSP00000363533
MAKFVIAGRADCPYYAKTELVADYLQKNLPDFRIHKITQRPEVWEDWLKDVCEKNKWSHKNSPIIWRELLDRGGKGLLLGGYNEFLEHAQLYYDVTSSMTTELMMVIAQENLGAHIEKEQEEEALKTCINPLQVWITSASAPACYNLIPILTSGEVFGMHTEISITLFDNKQAEEHLKSLVVETQDLASPVLRSVSICTKVEEAFRQAHVIVVLDDSTNKEVFTLEDCLRSRVPLCRLYGYLIEKNAHESVRVIVGGRTFVNLKTVLLMRYAPRIAHNIIAVALGVEGEAKAILARKLKTAPSYIKDVIIWGNISGNNYVDLRKTRVYRYESAIWGPLHYSRPVLNLIFDSEWVKREFVAILKNLTTTGRQFGGILAAHSIATTLKYWYHGSPPGEIVSLGILSEGQFGIPKGIVFSMPVKFENGTWVVLTDLKDVEISEQIMTRMTSDLIQEKLVALGDKIHFQPYQSGHKDLVPDEEKNLAMSDAAEFPNQIPQTTFEKPQSLEFLNEFEGKTVES

SEQ ID NO: 48870 - protein, 517 aa, Homo sapiens
  Payload ID: 9792
  Gene Symbol: MDH1B
  Gene Name: malate dehydrogenase 1B, NAD (soluble)
  Uniprot ID: Q5I0G3
  ENSP ID: ENSP00000389916
MAKFVIAGRADCPYYAKTELVADYLQKNLPDFRIHKITQRPEVWEDWLKDVCEKNKWSHKNSPIIWRELLDRGGKGLLLGGYNEFLEHAQLYYDVTSSMTTELMMVIAQENLGAHIEKEQEEEALKTCINPLQVWITSASAPACYNLIPILTSGEVFGMHTEISITLFDNKQAEEHLKSLVVETQDLASPVLRSVSICTKVEEAFRQAHVIVVLDDSTNKEVFTLEDCLRSRVPLCRLYGYLIEKNAHESVRVIVGGRTFVNLKTVLLMRYAPRIAHNIIAVALGVEGEAKAILARKLKTAPSYIKDVIIWGNISGNNYVDLRKTRVYRYESAIWGPLHYSRPVLNLIFDSEWVKREFVAILKNLTTTGRQFGGILAAHSIATTLKYWYHGSPPGEIVSLGILSEGQFGIPKGIVFSMPVKFENGTWVVLTDLKDVEISEQIMTRMTSDLIQEKLVALGDKIHFQPYQSGHKDLVPDEEKNLAMSDAEFPNQIPQTTFEKPQSLEFLNEFEGKTVES

SEQ ID NO: 48871 - protein, 283 aa, Homo sapiens
  Payload ID: 9792
  Gene Symbol: MDH1B
  Gene Name: malate dehydrogenase 1B, NAD (soluble)
  Uniprot ID: Q5I0G3
  ENSP ID: ENSP00000392464
MAKFVIAGRADCPYYAKTELVADYLQKNLPDFRIHKITQRPEVWEDWLKDVCEKNKWSHKNSPIIWRELLDRGGKGLLLGGYNEFLEHAQLYYDVTSSMTTELMMVIAQENLGAHIEKEQEEEALKTCINPLQVWITSEWVKREFVAILKNLTTTGRQFGGILAAHSIATTLKYWYHGSPPGEIVSLGILSEGQFGIPKGIVFSMPVKFENGTWVVLTDLKDVEISEQIMTRMTSDLIQEKLVALGDKIHFQPYQSDTPRINTLHPSIQSSWHSVLTITIRKR

SEQ ID NO: 48872 - protein, 133 aa, Homo sapiens
  Payload ID: 9792
  Gene Symbol: MDH1B
  Gene Name: malate dehydrogenase 1B, NAD (soluble)
  ENSP ID: ENSP00000403810
MAKFVIAGRADCPYYAKTELVADYLQKNLPDFRIHKITQRPEVWEDWLKDVCEKNKWSHKNSPIIWRELLDRGGKGLLLGGYNEFLEHAQLYYDVTSSMTTELMMVIAQENLGAHIEKEQEEEALKTCINPLQ

SEQ ID NO: 48873 - protein, 420 aa, Homo sapiens
  Payload ID: 9792
  Gene Symbol: MDH1B
  Gene Name: malate dehydrogenase 1B, NAD (soluble)
  ENSP ID: ENSP00000416577
MTTELMMVIAQENLGAHIEKEQEEEALKTCINPLQVWITSASAPACYNLIPILTSGEVFGMHTEISITLFDNKQAEEHLKSLVVETQDLASPVLRSVSICTKVEEAFRQAHVIVVLDDSTNKEVFTLEDCLRSRVPLCRLYGYLIEKNAHESVRVIVGGRTFVNLKTVLLMRYAPRIAHNIIAVALGVEGEAKAILARKLKTAPSYIKDVIIWGNISGNNYVDLRKTRVYRYESAIWGPLHYSRPVLNLIFDSEWVKREFVAILKNLTTTGRQFGGILAAHSIATTLKYWYHGSPPGEIVSLGILSEGQFGIPKGIVFSMPVKFENGTWVVLTDLKDVEISEQIMTRMTSDLIQEKLVALGDKIHFQPYQSGHKDLVPDEEKNLAMSDAAEFPNQIPQTTFEKPQSLEFLNEFEGKTVES

SEQ ID NO: 48874 - protein, 338 aa, Homo sapiens
  Payload ID: 9793
  Gene Symbol: MDH2
  Gene Name: malate dehydrogenase 2, NAD (mitochondrial)
  Uniprot ID: P40926
  ENSP ID: ENSP00000327070
MLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGRIQEAGTEVVKAKAGAGSATLSMAYAGARFVFSLVDAMNGKEGVVECSFVKSQETECTYFSTPLLLGKKGIEKNLGIGKVSSFEEKMISDAIPELKASIKKGEDFVKTLK

SEQ ID NO: 48875 - protein, 296 aa, Homo sapiens
  Payload ID: 9793
  Gene Symbol: MDH2
  Gene Name: malate dehydrogenase 2, NAD (mitochondrial)
  Uniprot ID: P40926
  ENSP ID: ENSP00000408649
MLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPGLDPARVNVPVIGGHAGKTIIPLISQCTPKVDFPQDQLTALTGRIQEAGTEVVKAKAGAGSATLSMAYAGARFVFSLVDAMNGKEGVVECSFVKSQETECTYFSTPLLLGKKGIEKNLGIGKVSSFEEKMISDAIPELKASIKKGEDFVKTLK

SEQ ID NO: 48876 - protein, 231 aa, Homo sapiens
  Payload ID: 9793
  Gene Symbol: MDH2
  Gene Name: malate dehydrogenase 2, NAD (mitochondrial)
  ENSP ID: ENSP00000416929
MTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGRIQEAGTEVVKAKAGAGSATLSMAYAGARFVFSLVDAMNGKEGVVECSFVKSQETECTYFSTPLLLGKKGIEKNLGIGKVSSFEEKMISDAIPELKASIKKGEDFVKTLK

SEQ ID NO: 48877 - protein, 28 aa, Homo sapiens
  Payload ID: 9793
  Gene Symbol: MDH2
  Gene Name: malate dehydrogenase 2, NAD (mitochondrial)
  ENSP ID: ENSP00000475583
MLSALARPASAALRRSFSTSAQRSIALT

SEQ ID NO: 48878 - protein, 623 aa, Homo sapiens
  Payload ID: 9794
  Gene Symbol: MAK
  Gene Name: male germ cell-associated kinase
  Uniprot ID: P20794
  ENSP ID: ENSP00000313021
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRLPEPVPSGSNHSTGENKSLPAVTSLKSDSELSTAPTSKQYYLKQSRYLPGVNPKKVSLIASGKEINPHTWSNQLFPKSLGPVGAELAFKRSNAGNLGSYATYNQSGYIPSFLKKEVQSAGQRIHLAPLNATASEYTWNTKTGRGQFSGRTYNPTAKNLNIVNRAQPIPSVHGRTDWVAKYGGHR

SEQ ID NO: 48879 - protein, 648 aa, Homo sapiens
  Payload ID: 9794
  Gene Symbol: MAK
  Gene Name: male germ cell-associated kinase
  Uniprot ID: P20794
  ENSP ID: ENSP00000346484
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRLPEPVPSGSNHSTGENKSLPAVTSLKSDSELSTAPTSKQYYLKQSRYLPGVNPKKVSLIASGKEINPHTWSNQLFPKSLGPVGAELAFKRSNAEESIIKPIEKLSCNETFPEKLEDPQGNLGSYATYNQSGYIPSFLKKEVQSAGQRIHLAPLNATASEYTWNTKTGRGQFSGRTYNPTAKNLNIVNRAQPIPSVHGRTDWVAKYGGHR

SEQ ID NO: 48880 - protein, 583 aa, Homo sapiens
  Payload ID: 9794
  Gene Symbol: MAK
  Gene Name: male germ cell-associated kinase
  Uniprot ID: P20794
  ENSP ID: ENSP00000442221
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRLPEPVPSGSNHSTGENKSLPAVTSLKSDSELSTAPTSKQYYLKQSRYLPGVNPKKVSLIASGKEINPHTWSNQLFPKSLGPVGAELAFKRSNAEYTWNTKTGRGQFSGRTYNPTAKNLNIVNRAQPIPSVHGRTDWVAKYGGHR

SEQ ID NO: 48881 - protein, 457 aa, Homo sapiens
  Payload ID: 9794
  Gene Symbol: MAK
  Gene Name: male germ cell-associated kinase
  ENSP ID: ENSP00000442250
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRQQVKMAVISLSAHQFPTL

SEQ ID NO: 48882 - protein, 623 aa, Homo sapiens; identical to SEQ ID NO: 48878
  Payload ID: 9794
  Gene Symbol: MAK
  Gene Name: male germ cell-associated kinase
  Uniprot ID: P20794
  ENSP ID: ENSP00000476067

SEQ ID NO: 48883 - protein, 292 aa, Homo sapiens
  Payload ID: 9795
  Gene Symbol: MLEC
  Gene Name: malectin
  Uniprot ID: Q14165
  ENSP ID: ENSP00000228506
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRL

SEQ ID NO: 48884 - protein, 146 aa, Homo sapiens
  Payload ID: 9795
  Gene Symbol: MLEC
  Gene Name: malectin
  ENSP ID: ENSP00000438950
MKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEK

SEQ ID NO: 48885 - protein, 217 aa, Homo sapiens
  Payload ID: 9795
  Gene Symbol: MLEC
  Gene Name: malectin
  ENSP ID: ENSP00000440746
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKMYQSFSLIRDWRRKKRKKKKKNMMKGLISKNRPIRTGCSQAPAHPTPMPRTTAASCFPSWWPSESSFQPSSASAGCENK

SEQ ID NO: 48886 - protein, 173 aa, Homo sapiens
  Payload ID: 9795
  Gene Symbol: MLEC
  Gene Name: malectin
  ENSP ID: ENSP00000441247
  MOD_RES (1)..(1): Any amino acid
XNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKMYQSFSLIRDWRRKKRKKKKKNMMKGLISKNRPIRTGCSQAPAHPTPMPRTTAASCFPSWWPSESSFQPSSASAGCENK

SEQ ID NO: 48887 - protein, 185 aa, Homo sapiens
  Payload ID: 9796
  Gene Symbol: MEA1
  Gene Name: male-enhanced antigen 1
  Uniprot ID: Q16626
  ENSP ID: ENSP00000244711
MGPERHLSGAPARMATVVLGGDTMGPERIFPNQTEELGHQGPSEGTGDWSSEEPEEEQEETGSGPAGYSYQPLNQDPEQEEVELAPVGDGDVVADIQDRIQALGLHLPDPPLESEDEDEEGATALNNHSSIPMDPEHVELVKRTMAGVSLPAPGVPAWAREISDAQWEDVVQKALQARQASPAWK

SEQ ID NO: 48888 - protein, 614 aa, Homo sapiens
  Payload ID: 9797
  Gene Symbol: MSL1
  Gene Name: male-specific lethal 1 homolog (Drosophila)
  Uniprot ID: Q68DK7
  ENSP ID: ENSP00000381543
MTMRSAVFKAAAAPAGGNPEQRLDYERAAALGGPEDEPGAAEAHFLPRHRKLKEPGPPLASSQGGSPAPSPAGCGGKGRGLLLPAGAAPGQQEESWGGSVPLPCPPPATKQAGIGGEPAAAGAGCSPRPKYQAVLPIQTGSLVAAAKEPTPWAGDKGGAASPAATASDPAGPPPLPLPGPPPLAPTATAGTLAASEGRWKSMRKSPLGGGGGSGASSQAACLKQILLLQLDLIEQQQQQLQAKEKEIEELKSERDTLLARIERMERRMQLVKKDNEKERHKLFQGYETEEREETELSEKIKLECQPELSETSQTLPPKPFSCGRSGKGHKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPPPSPLPLRESSPKKEETVARCLMPSSVAGETSVLAVPSWRDHSVEPLRDPNPSDLLENLDDSVFSKRHAKLELDEKRRKRWDIQRIREQRILQRLQLRMYKKKGIQESEPEVTSFFPEPDDVESLMITPFLPVVAFGRPLPKLTPQNFELPWLDERSRCRLEIQKKQTPHRTCRK

SEQ ID NO: 48889 - protein, 116 aa, Homo sapiens
  Payload ID: 9797
  Gene Symbol: MSL1
  Gene Name: male-specific lethal 1 homolog (Drosophila)
  ENSP ID: ENSP00000462114
MVVKGCESKHIQGDEMRVWLIGGFSADCGGFCSVPELLARIERMERRMQLVKKDNEKERHKLFQGYETEEREETELSEKIKLECQPELSETSQTLPPKPFSCGRSGKGHKRKSPFG

SEQ ID NO: 48890 - protein, 598 aa, Homo sapiens
  Payload ID: 9797
  Gene Symbol: MSL1
  Gene Name: male-specific lethal 1 homolog (Drosophila)
  ENSP ID: ENSP00000462731
MTMRSAVFKAAAAPAGGNPEQRLDYERAAALGGPEDEPGAAEAHFLPRHRKLKEPGPPLASSQGGSPAPSPAGCGGKGRGLLLPAGAAPGQQEESWGGSVPLPCPPPATKQAGIGGEPAAAGAGCSPRPKYQAVLPIQTGSLVAAAKEPTPWAGDKGGAASPAATASDPAGPPPLPLPGPPPLAPTATAGTLAASEGRWKSMRKSPLGGGGGSGASSQAACLKQILLLQLDLIEQQQQQLQAKEKEIEELKSERDTLLARIERMERRMQLVKKDNEKERHKLFQGYETEEREETELSEKIKLECQPELSETSQTLPPKPFSCGRSGKGHKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPPPSPLPLRESSPKKEETVAIPSWRDHSVEPLRDPNPSDLLENLDDSVFSKRHAKLELDEKRRKRWDIQRIREQRILQRLQLRMYKKKGIQESEPEVTSFFPEPDDVESLMITPFLPVVAFGRPLPKLTPQNFELPWLDERSRCRLEIQKKQTPHRTCRK

SEQ ID NO: 48891 - protein, 146 aa, Homo sapiens
  Payload ID: 9797
  Gene Symbol: MSL1
  Gene Name: male-specific lethal 1 homolog (Drosophila)
  ENSP ID: ENSP00000462915
KGHKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPPPSPLPLRESSPKKEETVARSTFTHLPCSEFKV

SEQ ID NO: 48892 - protein, 351 aa, Homo sapiens
  Payload ID: 9797
  Gene Symbol: MSL1
  Gene Name: male-specific lethal 1 homolog (Drosophila)
  Uniprot ID: Q68DK7
  ENSP ID: ENSP00000462945
MERRMQLVKKDNEKERHKLFQGYETEEREETELSEKIKLECQPELSETSQTLPPKPFSCGRSGKGHKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPPPSPLPLRESSPKKEETVARCLMPSSVAGETSVLAVPSWRDHSVEPLRDPNPSDLLENLDDSVFSKRHAKLELDEKRRKRWDIQRIREQRILQRLQLRMYKKKGIQESEPEVTSFFPEPDDVESLMITPFLPVVAFGRPLPKLTPQNFELPWLDERSRCRLEIQKKQTPHRTCRK

SEQ ID NO: 48893 - protein, 461 aa, Homo sapiens
  Payload ID: 9797
  Gene Symbol: MSL1
  Gene Name: male-specific lethal 1 homolog (Drosophila)
  ENSP ID: ENSP00000463949
MTMRSAVFKAAAAPAGGNPEQRLDYERAAALGGPEDEPGAAEAHFLPRHRKLKEPGPPLASSQGGSPAPSPAGCGGKGRGLLLPAGAAPGQQEESWGGSVPLPCPPPATKQAGIGGEPAAAGAGCSPRPKYQAVLPIQTGSLVAAAKEPTPWAGDKGGAASPAATASDPAGPPPLPLPGPPPLAPTATAGTLAASEGRWKSMRKSPLGGGGGSGASSQAACLKQILLLQLDLIEQQQQQLQAKEKEIEELKSERDTLLARIERMERRMQLVKKDNEKERHKLFQGYETEEREETELSEKIKLECQPELSETSQTLPPKPFSCGRSGKGHKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPPPSPLPLRESSPKKEETVASKA

SEQ ID NO: 48894 - protein, 577 aa, Homo sapiens
  Payload ID: 9798
  Gene Symbol: MSL2
  Gene Name: male-specific lethal 2 homolog (Drosophila)
  Uniprot ID: Q9HCI7
  ENSP ID: ENSP00000311827
MNPVNATALYISASRLVLNYDPGDPKAFTEINRLLPYFRQSLSCCVCGHLLQDPIAPTNSTCQHYVCKTCKGKKMMMKPSCSWCKDYEQFEENKQLSILVNCYKKLCEYITQTTLARDIIEAVDCSSDILALLNDGSLFCEETEKPSDSSFTLCLTHSPLPSTSEPTTDPQASLSPMSESTLSIAIGSSVINGLPTYNGLSIDRFGINIPSPEHSNTIDVCNTVDIKTEDLSDSLPPVCDTVATDLCSTGIDICSFSEDIKPGDSLLLSVEEVLRSLETVSNTEVCCPNLQPNLEATVSNGPFLQLSSQSLSHNVFMSTSPALHGLSCTAATPKIAKLNRKRSRSESDSEKVQPLPISTIIRGPTLGASAPVTVKRESKISLQPIATVPNGGTTPKISKTVLLSTKSMKKSHEHGSKKSHSKTKPGILKKDKAVKEKIPSHHFMPGSPTKTVYKKPQEKKGCKCGRATQNPSVLTCRGQRCPCYSNRKACLDCICRGCQNSYMANGEKKLEAFAVPEKALEQTRLTLGINVTSIAVRNASTSTSVINVTGSPVTTFLAASTHDDKSLDEAIDMRFDC

SEQ ID NO: 48895 - protein, 503 aa, Homo sapiens
  Payload ID: 9798
  Gene Symbol: MSL2
  Gene Name: male-specific lethal 2 homolog (Drosophila)
  Uniprot ID: Q9HCI7
  ENSP ID: ENSP00000387948
MMMKPSCSWCKDYEQFEENKQLSILVNCYKKLCEYITQTTLARDIIEAVDCSSDILALLNDGSLFCEETEKPSDSSFTLCLTHSPLPSTSEPTTDPQASLSPMSESTLSIAIGSSVINGLPTYNGLSIDRFGINIPSPEHSNTIDVCNTVDIKTEDLSDSLPPVCDTVATDLCSTGIDICSFSEDIKPGDSLLLSVEEVLRSLETVSNTEVCCPNLQPNLEATVSNGPFLQLSSQSLSHNVFMSTSPALHGLSCTAATPKIAKLNRKRSRSESDSEKVQPLPISTIIRGPTLGASAPVTVKRESKISLQPIATVPNGGTTPKISKTVLLSTKSMKKSHEHGSKKSHSKTKPGILKKDKAVKEKIPSHHFMPGSPTKTVYKKPQEKKGCKCGRATQNPSVLTCRGQRCPCYSNRKACLDCICRGCQNSYMANGEKKLEAFAVPEKALEQTRLTLGINVTSIAVRNASTSTSVINVTGSPVTTFLAASTHDDKSLDEAIDMRFDC

SEQ ID NO: 48896 - protein, 149 aa, Homo sapiens
  Payload ID: 9798
  Gene Symbol: MSL2
  Gene Name: male-specific lethal 2 homolog (Drosophila)
  ENSP ID: ENSP00000417956
MMMKPSCSWCKDYEQFEENKQLSILVNCYKKLCEYITQTTLARDIIEAVDCSSDILALLNDGSLFCEETEKPSDSSFTLCLTHSPLPSTSEPTTDPQASLSPMSESTLSIAIGSSVINGLPTYNGLSIDRFGINIPSPEHSNTIDVCNT

SEQ ID NO: 48897 - protein, 95 aa, Homo sapiens
  Payload ID: 9798
  Gene Symbol: MSL2
  Gene Name: male-specific lethal 2 homolog (Drosophila)
  ENSP ID: ENSP00000418655
MMMKPSCSWCKDYEQFEENKQLSILVNCYKKLCEYITQTTLARDIIEAVDCSSDILALLNDGSLFCEETEKPSDSSFTLCLTHSPLPSTSEPTTD

SEQ ID NO: 48898 - protein, 154 aa, Homo sapiens
  Payload ID: 9798
  Gene Symbol: MSL2
  Gene Name: male-specific lethal 2 homolog (Drosophila)
  ENSP ID: ENSP00000418752
MMMKPSCSWCKDYEQFEENKQLSILVNCYKKLCEYITQTTLARDIIEAVDCSSDILALLNDGSLFCEETEKPSDSSFTLCLTHSPLPSTSEPTTDPQASLSPMSESTLSIAIGSSVINGLPTYNGLSIDRFGINIPSPEHSNTIDVCNTVDIKT

SEQ ID NO: 48899 - protein, 521 aa, Homo sapiens
  Payload ID: 9799
  Gene Symbol: MSL3
  Gene Name: male-specific lethal 3 homolog (Drosophila)
  Uniprot ID: Q8N5Y2
  ENSP ID: ENSP00000312244
MSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 48900 - protein, 416 aa, Homo sapiens
  Payload ID: 9799
  Gene Symbol: MSL3
  Gene Name: male-specific lethal 3 homolog (Drosophila)
  Uniprot ID: Q8N5Y2
  ENSP ID: ENSP00000338078
MSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKSRFILGCPRPGRASVYFVFSQCQAWC

SEQ ID NO: 48901 - protein, 372 aa, Homo sapiens
  Payload ID: 9799
  Gene Symbol: MSL3
  Gene Name: male-specific lethal 3 homolog (Drosophila)
  Uniprot ID: Q8N5Y2
  ENSP ID: ENSP00000354562
MKMMKTKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 48902 - protein, 116 aa, Homo sapiens
  Payload ID: 9799
  Gene Symbol: MSL3
  Gene Name: male-specific lethal 3 homolog (Drosophila)
  ENSP ID: ENSP00000370067
VKHFAINAAFSANERPRHHHVMPHANMNVHYIPAEKNVDLCKEMVDGLRITFDYTLPLVLLYPYEQAQYKKVTSSKFFLPIKESATSTNSPQRVSRPPVNQPPPKGAKLSQKHCSL

SEQ ID NO: 48903 - protein, 196 aa, Homo sapiens
  Payload ID: 9799
  Gene Symbol: MSL3
  Gene Name: male-specific lethal 3 homolog (Drosophila)
  ENSP ID: ENSP00000370068
MEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLS

SEQ ID NO: 48904 - protein, 355 aa, Homo sapiens
  Payload ID: 9799
  Gene Symbol: MSL3
  Gene Name: male-specific lethal 3 homolog (Drosophila)
  Uniprot ID: Q8N5Y2
  ENSP ID: ENSP00000370069
MEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 48905 - protein, 509 aa, Homo sapiens
  Payload ID: 9799
  Gene Symbol: MSL3
  Gene Name: male-specific lethal 3 homolog (Drosophila)
  Uniprot ID: Q8N5Y2
  ENSP ID: ENSP00000381538
MSPSVRPGAGWAPVGRPGRPIQIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 48906 - protein, 224 aa, Homo sapiens
  Payload ID: 9799
  Gene Symbol: MSL3
  Gene Name: male-specific lethal 3 homolog (Drosophila)
  ENSP ID: ENSP00000401809
MSPSVRPGAGWAPVGRPGRPIQIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMP

SEQ ID NO: 48907 - protein, 127 aa, Homo sapiens
  Payload ID: 9799
  Gene Symbol: MSL3
  Gene Name: male-specific lethal 3 homolog (Drosophila)
  ENSP ID: ENSP00000418673
MSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDEN

SEQ ID NO: 48908 - protein, 19 aa, Homo sapiens
  Payload ID: 9799
  Gene Symbol: MSL3
  Gene Name: male-specific lethal 3 homolog (Drosophila)
  ENSP ID: ENSP00000419976
MEERTITIEIPEVLKKQLE

SEQ ID NO: 48909 - protein, 572 aa, Homo sapiens
  Payload ID: 9800
  Gene Symbol: ME1
  Gene Name: malic enzyme 1, NADP(+)-dependent, cytosolic
  Uniprot ID: P48163
  ENSP ID: ENSP00000358719
MEPEAPRRRHTHQRGYLLTRNPHLNKDLAFTLEERQQLNIHGLLPPSFNSQEIQVLRVVKNFEHLNSDFDRYLLLMDLQDRNEKLFYRVLTSDIEKFMPIVYTPTVGLACQQYSLVFRKPRGLFITIHDRGHIASVLNAWPEDVIKAIVVTDGERILGLGDLGCNGMGIPVGKLALYTACGGMNPQECLPVILDVGTENEELLKDPLYIGLRQRRVRGSEYDDFLDEFMEAVSSKYGMNCLIQFEDFANVNAFRLLNKYRNQYCTFNDDIQGTASVAVAGLLAALRITKNKLSDQTILFQGAGEAALGIAHLIVMALEKEGLPKEKAIKKIWLVDSKGLIVKGRASLTQEKEKFAHEHEEMKNLEAIVQEIKPTALIGVAAIGGAFSEQILKDMAAFNERPIIFALSNPTSKAECSAEQCYKITKGRAIFASGSPFDPVTLPNGQTLYPGQGNNSYVFPGVALGVVACGLRQITDNIFLTTAEVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 48910 - protein, 584 aa, Homo sapiens
  Payload ID: 9801
  Gene Symbol: ME2
  Gene Name: malic enzyme 2, NAD(+)-dependent, mitochondrial
  Uniprot ID: P23368
  ENSP ID: ENSP00000321070
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGVALAVILCNTRHISDSVFLEAAKALTSQLTDEELAQGRLYPPLANIQEVSINIAIKVTEYLYANKMAFRYPEPEDKAKYVKERTWRSEYDSLLPDVYEWPESASSPPVITE

SEQ ID NO: 48911 - protein, 479 aa, Homo sapiens
  Payload ID: 9801
  Gene Symbol: ME2
  Gene Name: malic enzyme 2, NAD(+)-dependent, mitochondrial
  Uniprot ID: P23368
  ENSP ID: ENSP00000372384
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGYRIPIC

SEQ ID NO: 48912 - protein, 259 aa, Homo sapiens
  Payload ID: 9802
  Gene Symbol: ME3
  Gene Name: malic enzyme 3, NADP(+)-dependent, mitochondrial
  ENSP ID: ENSP00000315255
MAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQDDFSRGPKRSQLFFK

SEQ ID NO: 48913 - protein, 604 aa, Homo sapiens
  Payload ID: 9802
  Gene Symbol: ME3
  Gene Name: malic enzyme 3, NADP(+)-dependent, mitochondrial
  Uniprot ID: Q16798
  ENSP ID: ENSP00000376998
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTASVAVAGILAALRITKNKLSNHVFVFQGAGEAAMGIAHLLVMALEKEGVPKAEATRKIWMVDSKGLIVKGRSHLNHEKEMFAQDHPEVNSLEEVVRLVKPTAIIGVAAIAGAFTEQILRDMASFHERPIIFALSNPTSKAECTAEKCYRVTEGRGIFASGSPFKSVTLEDGKTFIPGQGNNAYVFPGVALGVIAGGIRHIPDEIFLLTAEQIAQEVSEQHLSQGRLYPPLSTIRDVSLRIAIKVLDYAYKHNLASYYPEPKDKEAFVRSLVYTPDYDSFTLDSYTWPKEAMNVQTV

SEQ ID NO: 48914 - protein, 580 aa, Homo sapiens
  Payload ID: 9802
  Gene Symbol: ME3
  Gene Name: malic enzyme 3, NADP(+)-dependent, mitochondrial
  ENSP ID: ENSP00000431182
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTASVAVAGILAALRITKNKLSNHVFVFQGAGEAAMGIAHLLVMALEKEGVPKAEATRKIWMVDSKGLIVKGRSHLNHEKEMFAQDHPEVNSLEEVVRLVKPTAIIGVAAIAGAFTEQILRDMASFHERPIIFALSNPTSKAECTAEKCYRVTEGRGIFASGSPFKSVTLEDGKTFIPGQGNNAYVFPGVALGVIAGGIRHIPDEIFLLTAEQIAQEVSEQHLSQGRLYPPLSTIRDVSLRIAIKVLDYAYKHNLASYYPEPKDKEAFVRSLVY

SEQ ID NO: 48915 - protein, 342 aa, Homo sapiens
  Payload ID: 9802
  Gene Symbol: ME3
  Gene Name: malic enzyme 3, NADP(+)-dependent, mitochondrial
  Uniprot ID: Q16798
  ENSP ID: ENSP00000433636
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTTCHTFSCPWHLWAQVMFQHIPGPMGFSEWLPRNS

SEQ ID NO: 48916 - protein, 61 aa, Homo sapiens
  Payload ID: 9802
  Gene Symbol: ME3
  Gene Name: malic enzyme 3, NADP(+)-dependent, mitochondrial
  ENSP ID: ENSP00000434431
MGAALGTGTRLAPWPGRACGALPRWTPTAPAQGCHSKPGPARPVPLKKRGYDVTRNPHLNK

SEQ ID NO: 48917 - protein, 151 aa, Homo sapiens
  Payload ID: 9802
  Gene Symbol: ME3
  Gene Name: malic enzyme 3, NADP(+)-dependent, mitochondrial
  ENSP ID: ENSP00000434690
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLT

SEQ ID NO: 48918 - protein, 79 aa, Homo sapiens
  Payload ID: 9802
  Gene Symbol: ME3
  Gene Name: malic enzyme 3, NADP(+)-dependent, mitochondrial
  ENSP ID: ENSP00000435427
MGAALGTGTRLAPWPGRACGALPRWTPTAPAQGCHSKPGPARPVPLKKRGYDVTRNPHLNKVMGQRAGRPALRSRGCRK

SEQ ID NO: 48919 - protein, 61 aa, Homo sapiens; identical to SEQ ID NO: 48916
  Payload ID: 9802
  Gene Symbol: ME3
  Gene Name: malic enzyme 3, NADP(+)-dependent, mitochondrial
  ENSP ID: ENSP00000437204

SEQ ID NO: 48920 - protein, 604 aa, Homo sapiens; identical to SEQ ID NO: 48913
  Payload ID: 9802
  Gene Symbol: ME3
  Gene Name: malic enzyme 3, NADP(+)-dependent, mitochondrial
  Uniprot ID: Q16798
  ENSP ID: ENSP00000440246

SEQ ID NO: 48921 - protein, 1052 aa, Homo sapiens
  Payload ID: 9803
  Gene Symbol: MFHAS1
  Gene Name: malignant fibrous histiocytoma amplified sequence 1
  Uniprot ID: Q9Y4C4
  ENSP ID: ENSP00000276282
MAGMDSGNLKTARLWRDAALRARKLRSNLRQLTLTAAGACPGAGADALESPASPQLVLPANLGDIEALNLGNNGLEEVPEGLGSALGSLRVLVLRRNRFARLPPAVAELGHHLTELDVSHNRLTALGAEVVSALRELRKLNLSHNQLPALPAQLGALAHLEELDVSFNRLAHLPDSLSCLSRLRTLDVDHNQLTAFPRQLLQLVALEELDVSSNRLRGLPEDISALRALKILWLSGAELGTLPAGFCELASLESLMLDNNGLQALPAQFSCLQRLKMLNLSSNLFEEFPAALLPLAGLEELYLSRNQLTSVPSLISGLGRLLTLWLDNNRIRYLPDSIVELTGLEELVLQGNQIAVLPDHFGQLSRVGLWKIKDNPLIQPPYEVCMKGIPYIAAYQKELAHSQPAVQPRLKLLLMGHKAAGKTLLRHCLTEERVEGCPGGGDKEKCYPPSPPPVSKGIEVTSWTADASRGLRFIVYDLAGDESYEVIQPFFLSPGALYVLVVNLATYEPRHFPTTVGSFLHRVGARVPHAVVCIVGTHADLCGERELEEKCLDIHRQIALQEKHDAEGLSRLAKVVDEALARDFELRSASPHAAYYGVSDKNLRRRKAHFQYLLNHRLQILSPVLPVSCRDPRHLRRLRDKLLSVAEHREIFPNLHRVLPRSWQVLEELHFQPPQAQRLWLSWWDSARLGLQAGLTEDRLQSALSYLHESGKLLYFEDSPALKEHVFHNLTRLIDILNVFFQRDPSLLLHKLLLGTSGEGKAEGESSPPMARSTPSQELLRATQLHQYVEGFLLHGLLPAHVIRLLLKPHVQAQQDLQLLLELLEKMGLCYCLNKPKGKPLNGSTAWYKFPCYVQNEVPHAEAWINGTNLAGQSFVAEQLQIEYSFPFTFPLGLFARYSVQINSHVVHRSDGKFQIFAYRGKVPVVVSYRPARGVLQPDTLSIASHASLPNIWTAWQAITPLVEELNVLLQEWPGLHYTVHILCSKCLKRGSPNPHAFPGELLSQPRPEGVAEIICPKNGSERVNVALVYPPTPTVISPCSKKNVGEKHRNQ

SEQ ID NO: 48922 - protein, 182 aa, Homo sapiens
  Payload ID: 9804
  Gene Symbol: MCTS1
  Gene Name: malignant T cell amplified sequence 1
  Uniprot ID: Q9ULC4
  ENSP ID: ENSP00000360365
MGKGRFDEKENVSNCIQLKTSVIKGIKNQLIEQFPGIEPWLNQIMPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKVNKGIGIENIHYLNDGLWHMKTYK

SEQ ID NO: 48923 - protein, 181 aa, Homo sapiens
  Payload ID: 9804
  Gene Symbol: MCTS1
  Gene Name: malignant T cell amplified sequence 1
  Uniprot ID: Q9ULC4
  ENSP ID: ENSP00000360367
MFKKFDEKENVSNCIQLKTSVIKGIKNQLIEQFPGIEPWLNQIMPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKVNKGIGIENIHYLNDGLWHMKTYK

SEQ ID NO: 48924 - protein, 390 aa, Homo sapiens
  Payload ID: 9805
  Gene Symbol: MCAT
  Gene Name: malonyl CoA:ACP acyltransferase (mitochondrial)
  Uniprot ID: Q8IVS2
  ENSP ID: ENSP00000290429
MSVRVARVAWVRGLGASYRRGASSFPVPPPGAQGVAELLRDATGAEEEAPWAATERRMPGQCSVLLFPGQGSQVVGMGRGLLNYPRVRELYAAARRVLGYDLLELSLHGPQETLDRTVHCQPAIFVASLAAVEKLHHLQPSVIENCVAAAGFSVGEFAALVFAGAMEFAEGLYAVKIRAEAMQEASEAVPSGMLSVLGQPQSKFNFACLEAREHCKSLGIENPVCEVSNYLFPDCRVISGHQEALRFLQKNSSKFHFRRTRMLPVSGAFHTRLMEPAVEPLTQALKAVDIKKPLVSVYSNVHAHRYRHPGHIHKLLAQQLVSPVKWEQTMHAIYERKKGRGFPQTFEVGPGRQLGAILKSCNMQAWKSYSAVDVLQTLEHVDLDPQEPPR

SEQ ID NO: 48925 - protein, 180 aa, Homo sapiens
  Payload ID: 9805
  Gene Symbol: MCAT
  Gene Name: malonyl CoA:ACP acyltransferase (mitochondrial)
  Uniprot ID: Q8IVS2
  ENSP ID: ENSP00000331306
MSVRVARVAWVRGLGASYRRGASSFPVPPPGAQGVAELLRDATGAEEEAPWAATERRMPGQCSVLLFPGQGSQVVGMGRGLLNYPRVRELYAAARRVLGYDLLELSLHGPQETLDRTVHCQPAIFVASLAAVEKLHHLQPSVIENCVAAAGFSVGEFAALVFAGAMEFAEGSTVSPEEFL

SEQ ID NO: 48926 - protein, 87 aa, Homo sapiens
  Payload ID: 9805
  Gene Symbol: MCAT
  Gene Name: malonyl CoA:ACP acyltransferase (mitochondrial)
  ENSP ID: ENSP00000477216
LAAVEKLHHLQPSVIENCVAAAGFSVGEFAALVFAGAMEFAEGTGRSLVLCKAVVLGSLGVRDTAKNDTGPTQVMGREHMDRGDIGT

SEQ ID NO: 48927 - protein, 493 aa, Homo sapiens
  Payload ID: 9806
  Gene Symbol: MLYCD
  Gene Name: malonyl-CoA decarboxylase
  Uniprot ID: O95822
  ENSP ID: ENSP00000262430
MRGFGPGLTARRLLPLRLPPRPPGPRLASGQAAGALERAMDELLRRAVPPTPAYELREKTPAPAEGQCADFVSFYGGLAETAQRAELLGRLARGFGVDHGQVAEQSAGVLHLRQQQREAAVLLQAEDRLRYALVPRYRGLFHHISKLDGGVRFLVQLRADLLEAQALKLVEGPDVREMNGVLKGMLSEWFSSGFLNLERVTWHSPCEVLQKISEAEAVHPVKNWMDMKRRVGPYRRCYFFSHCSTPGEPLVVLHVALTGDISSNIQAIVKEHPPSETEEKNKITAAIFYSISLTQQGLQGVELGTFLIKRVVKELQREFPHLGVFSSLSPIPGFTKWLLGLLNSQTKEHGRNELFTDSECKEISEITGGPINETLKLLLSSSEWVQSEKLVRALQTPLMRLCAWYLYGEKHRGYALNPVANFHLQNGAVLWRINWMADVSLRGITGSCGLMANYRYFLEETGPNSTSYLGSKIIKASEQVLSLVAQFQKNSKL

SEQ ID NO: 48928 - protein, 813 aa, Homo sapiens
  Payload ID: 9807
  Gene Symbol: MALT1
  Gene Name: MALT1 paracaspase
  Uniprot ID: Q9UDY8
  ENSP ID: ENSP00000304161
MSLLGDPLQALPPSAAPTGPLLAPPAGATLNRLREPLLRRLSELLDQAPEGRGWRRLAELAGSRGRLRLSCLDLEQCSLKVLEPEGSPSLCLLKLMGEKGCTVTELSDFLQAMEHTEVLQLLSPPGIKITVNPESKAVLAGQFVKLCCRATGHPFVQYQWFKMNKEIPNGNTSELIFNAVHVKDAGFYVCRVNNNFTFEFSQWSQLDVCDIPESFQRSVDGVSESKLQICVEPTSQKLMPGSTLVLQCVAVGSPIPHYQWFKNELPLTHETKKLYMVPYVDLEHQGTYWCHVYNDRDSQDSKKVEIIIDELNNLGHPDNKEQTTDQPLAKDKVALLIGNMNYREHPKLKAPLVDVYELTNLLRQLDFKVVSLLDLTEYEMRNAVDEFLLLLDKGVYGLLYYAGHGYENFGNSFMVPVDAPNPYRSENCLCVQNILKLMQEKETGLNVFLLDMCRKRNDYDDTIPILDALKVTANIVFGYATCQGAEAFEIQHSGLANGIFMKFLKDRLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKEHLVFTVCLSYQYSGLEDTVEDKQEVNVGKPLIAKLDMHRGLGRKTCFQTCLMSNGPYQSSAATSGGAGHYHSLQDPFHGVYHSHPGNPSNVTPADSCHCSRTPDAFISSFAHHASCHFSRSNVPVETTDEIPFSFSDRLRISEK

SEQ ID NO: 48929 - protein, 824 aa, Homo sapiens
  Payload ID: 9807
  Gene Symbol: MALT1
  Gene Name: MALT1 paracaspase
  Uniprot ID: Q9UDY8
  ENSP ID: ENSP00000319279
MSLLGDPLQALPPSAAPTGPLLAPPAGATLNRLREPLLRRLSELLDQAPEGRGWRRLAELAGSRGRLRLSCLDLEQCSLKVLEPEGSPSLCLLKLMGEKGCTVTELSDFLQAMEHTEVLQLLSPPGIKITVNPESKAVLAGQFVKLCCRATGHPFVQYQWFKMNKEIPNGNTSELIFNAVHVKDAGFYVCRVNNNFTFEFSQWSQLDVCDIPESFQRSVDGVSESKLQICVEPTSQKLMPGSTLVLQCVAVGSPIPHYQWFKNELPLTHETKKLYMVPYVDLEHQGTYWCHVYNDRDSQDSKKVEIIIGRTDEAVECTEDELNNLGHPDNKEQTTDQPLAKDKVALLIGNMNYREHPKLKAPLVDVYELTNLLRQLDFKVVSLLDLTEYEMRNAVDEFLLLLDKGVYGLLYYAGHGYENFGNSFMVPVDAPNPYRSENCLCVQNILKLMQEKETGLNVFLLDMCRKRNDYDDTIPILDALKVTANIVFGYATCQGAEAFEIQHSGLANGIFMKFLKDRLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKEHLVFTVCLSYQYSGLEDTVEDKQEVNVGKPLIAKLDMHRGLGRKTCFQTCLMSNGPYQSSAATSGGAGHYHSLQDPFHGVYHSHPGNPSNVTPADSCHCSRTPDAFISSFAHHASCHFSRSNVPVETTDEIPFSFSDRLRISEK

SEQ ID NO: 48930 - protein, 119 aa, Homo sapiens
  Payload ID: 9807
  Gene Symbol: MALT1
  Gene Name: MALT1 paracaspase
  ENSP ID: ENSP00000467222
MGEKGCTVTELSDFLQAMEHTEVLQLLSPPGIKITVNPESKAVLAGQFVKLCCRATGHPFVQYQWFKMNKEIPNGNTSELIFNAVHVKDAGFYVCRVNNNFTFEFSQWSQLDVCDIPES

SEQ ID NO: 48931 - protein, 143 aa, Homo sapiens
  Payload ID: 9808
  Gene Symbol: MGAM
  Gene Name: maltase-glucoamylase
  ENSP ID: ENSP00000417103
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGN

SEQ ID NO: 48932 - protein, 2753 aa, Homo sapiens
  Payload ID: 9808
  Gene Symbol: MGAM
  Gene Name: maltase-glucoamylase
  ENSP ID: ENSP00000417515
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGNLVNTNAGFTARLKNLPSSPVFGSNVDNVLLTAEYQTSNRFHFKLTDQTNNRFEVPHEHVQSFSGNAAASLTYQVEISRQPFSIKVTRRSNNRVLFDSSIGPLLFADQFLQLSTRLPSTNVYGLGEHVHQQYRHDMNWKTWPIFNRDTTPNGNGTNLYGAQTFFLCLEDASGLSFGVFLMNSNAMEVVLQPAPAITYRTIGGILDFYVFLGNTPEQVVQEYLELIGRPALPSYWALGFHLSRYEYGTLDNMREVVERNRAAQLPYDVQHADIDYMDERRDFTYDSVDFKGFPEFVNELHNNGQKLVIIVDPAISNNSSSSKPYGPYDRGSDMKIWVNSSDGVTPLIGEVWPGQTVFPDYTNPNCAVWWTKEFELFHNQVEFDGIWIDMNEVSNFVDGSVSGCSTNNLNNPPFTPRILDGYLFCKTLCMDAVQHWGKQYDIHNLYGYSMAVATAEAAKTVFPNKRSFILTRSTFAGSGKFAAHWLGDNTATWDDLRWSIPGVLEFNLFGIPMVGPDICGFALDTPEELCRRWMQLGAFYPFSRNHNGQGYKDQDPASFGADSLLLNSSRHYLNIRYTLLPYLYTLFFRAHSRGDTVARPLLHEFYEDNSTWDVHQQFLWGPGLLITPVLDEGAEKVMAYVPDAVWYDYETGSQVRWRKQKVEMELPGDKIGLHLRGGYIFPTQQPNTTTLASRKNPLGLIIALDENKEAKGELFWDNGETKDTVANKVYLLCEFSVTQNRLEVNISQSTYKDPNNLAFNEIKILGTEEPSNVTVKHNGVPSQTSPTVTYDSNLKVAIITDIDLLLGEAYTVEWSIKIRDEEKIDCYPDENGASAENCTARGCIWEASNSSGVPFCYFVNDLYSVSDVQYNSHGATADISLKSSVYANAFPSTPVNPLRLDVTYHKNEMLQFKIYDPNKNRYEVPVPLNIPSMPSSTPEGQLYDVLIKKNPFGIEIRRKSTGTIIWDSQLLGFTFSDMFIRISTRLPSKYLYGFGETEHRSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEIASLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPHLESRDRGLSSKTLCMESQQILPDGSLVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDAAFVNISRNVLQTRYTLLPYLYTLMQKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRKNPLGLIIALDENKEAKGELFWDDGQTKDTVAKKVYLLCEFSVTQNHLEVTISQSTYKDPNNLAFNEIKILGMEEPSNVTVKHNGVPSQTSPTVTYDSNLKVAIITDINLFLGEAYTVEWSIKIRDEEKIDCYPDENGDSAENCTARGCIWEASNSSGVPFCYFVNDLYSVSDVQYNSHGATADISLKSSVHANAFPSTPVNPLRLDVTYHKNEMLQFKIYDPNNNRYEVPVPLNIPSVPSSTPEGQLYDVLIKKNPFGIEIRRKSTGTIIWDSQLLGFTFNDMFIRISTRLPSKYLYGFGETEHTSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEISSLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPYLESRDRGLSSKTLCMESQQILPDGSPVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDVAFVNISRTVLQTRYTLLPYLYTLMHKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRQKFMGFKIALDDEGTAGGWLFWDDGQSIDTYGKGLYYLASFSASQNTMQSHIIFNNYITGTNPLKLGYIEIWGVGSVPVTSVSISVSGMVITPSFNNDPTTQVLSIDVTDRNISLHNFTSLTWISTL

SEQ ID NO: 48933 - protein, 185 aa, Homo sapiens
  Payload ID: 9808
  Gene Symbol: MGAM
  Gene Name: maltase-glucoamylase
  ENSP ID: ENSP00000419372
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGNLVNTNAGFTARLKNLPSSPVFGSNVDNVLLTAEYQTSNRFHF

SEQ ID NO: 48934 - protein, 1857 aa, Homo sapiens
  Payload ID: 9808
  Gene Symbol: MGAM
  Gene Name: maltase-glucoamylase
  Uniprot ID: O43451
  ENSP ID: ENSP00000447378
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGNLVNTNAGFTARLKNLPSSPVFGSNVDNVLLTAEYQTSNRFHFKLTDQTNNRFEVPHEHVQSFSGNAAASLTYQVEISRQPFSIKVTRRSNNRVLFDSSIGPLLFADQFLQLSTRLPSTNVYGLGEHVHQQYRHDMNWKTWPIFNRDTTPNGNGTNLYGAQTFFLCLEDASGLSFGVFLMNSNAMEVVLQPAPAITYRTIGGILDFYVFLGNTPEQVVQEYLELIGRPALPSYWALGFHLSRYEYGTLDNMREVVERNRAAQLPYDVQHADIDYMDERRDFTYDSVDFKGFPEFVNELHNNGQKLVIIVDPAISNNSSSSKPYGPYDRGSDMKIWVNSSDGVTPLIGEVWPGQTVFPDYTNPNCAVWWTKEFELFHNQVEFDGIWIDMNEVSNFVDGSVSGCSTNNLNNPPFTPRILDGYLFCKTLCMDAVQHWGKQYDIHNLYGYSMAVATAEAAKTVFPNKRSFILTRSTFAGSGKFAAHWLGDNTATWDDLRWSIPGVLEFNLFGIPMVGPDICGFALDTPEELCRRWMQLGAFYPFSRNHNGQGYKDQDPASFGADSLLLNSSRHYLNIRYTLLPYLYTLFFRAHSRGDTVARPLLHEFYEDNSTWDVHQQFLWGPGLLITPVLDEGAEKVMAYVPDAVWYDYETGSQVRWRKQKVEMELPGDKIGLHLRGGYIFPTQQPNTTTLASRKNPLGLIIALDENKEAKGELFWDNGETKDTVANKVYLLCEFSVTQNRLEVNISQSTYKDPNNLAFNEIKILGTEEPSNVTVKHNGVPSQTSPTVTYDSNLKVAIITDIDLLLGEAYTVEWSIKIRDEEKIDCYPDENGASAENCTARGCIWEASNSSGVPFCYFVNDLYSVSDVQYNSHGATADISLKSSVYANAFPSTPVNPLRLDVTYHKNEMLQFKIYDPNKNRYEVPVPLNIPSMPSSTPEGQLYDVLIKKNPFGIEIRRKSTGTIIWDSQLLGFTFSDMFIRISTRLPSKYLYGFGETEHRSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEIASLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPHLESRDRGLSSKTLCMESQQILPDGSLVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDVAFVNISRTVLQTRYTLLPYLYTLMHKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRQKFMGFKIALDDEGTAGGWLFWDDGQSIDTYGKGLYYLASFSASQNTMQSHIIFNNYITGTNPLKLGYIEIWGVGSVPVTSVSISVSGMVITPSFNNDPTTQVLSIDVTDRNISLHNFTSLTWISTL

SEQ ID NO: 48935 - protein, 1857 aa, Homo sapiens; identical to SEQ ID NO: 48934
  Payload ID: 9808
  Gene Symbol: MGAM
  Gene Name: maltase-glucoamylase
  Uniprot ID: O43451
  ENSP ID: ENSP00000482292

SEQ ID NO: 48936 - protein, 2012 aa, Homo sapiens
  Payload ID: 9808
  Gene Symbol: MGAM
  Gene Name: maltase-glucoamylase
  ENSP ID: ENSP00000487740
  MOD_RES (1)..(1): Any amino acid
XFRFYEDNSTWDVHQQFLWGPGLLITPVLDEGAEKVMAYVPDAVWYDYETGSQVRWRKQKVEMELPGDKIGLHLRGGYIFPTQQPNTTTLASRKNPLGLIIALDENKEAKGELFWDNGETKDTVANKVYLLCEFSVTQNRLEVNISQSTYKDPNNLAFNEIKILGTEEPSNVTVKHNGVPSQTSPTVTYDSNLKVAIITDIDLLLGEAYTVEWSIKIRDEEKIDCYPDENGASAENCTARGCIWEASNSSGVPFCYFVNDLYSVSDVQYNSHGATADISLKSSVYANAFPSTPVNPLRLDVTYHKNEMLQFKIYDPNKNRYEVPVPLNIPSMPSSTPEGQLYDVLIKKNPFGIEIRRKSTGTIIWDSQLLGFTFSDMFIRISTRLPSKYLYGFGETEHRSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEIASLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPHLESRDRGLSSKTLCMESQQILPDGSLVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDAAFVNISRNVLQTRYTLLPYLYTLMQKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRKNPLGLIIALDENKEAKGELFWDDGQTKDTVAKKVYLLCEFSVTQNHLEVTISQSTYKDPNNLAFNEIKILGMEEPSNVTVKHNGVPSQTSPTVTYDSNLKVAIITDINLFLGEAYTVEWSIKIRDEEKIDCYPDENGDSAENCTARGCIWEASNSSGVPFCYFVNDLYSVSDVQYNSHGATADISLKSSVHANAFPSTPVNPLRLDVTYHKNEMLQFKIYDPNNNRYEVPVPLNIPSVPSSTPEGQLYDVLIKKNPFGIEIRRKSTGTIIWDSQLLGFTFNDMFIRISTRLPSKYLYGFGETEHTSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEISSLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPYLESRDRGLSSKTLCMESQQILPDGSPVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDVAFVNISRTVLQTRYTLLPYLYTLMHKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRQKFMGFKIALDDEGTAGGWLFWDDGQSIDTYGKGLYYLASFSASQNTMQSHIIFNNYITGTNPLKLGYIEIWGVGSVPVTSVSISVSGMVITPSFNNDPTTQVLSIDVTDRNISLHNFTSLTWISTL

SEQ ID NO: 48937 - protein, 1114 aa, Homo sapiens
  Payload ID: 9808
  Gene Symbol: MGAM
  Gene Name: maltase-glucoamylase
  ENSP ID: ENSP00000488282
  MOD_RES (1)..(1): Any amino acid
XFYEDNSTWDVHQQFLWGPGLLITPVLDEGAEKVMAYVPDAVWYDYETGSQVRWRKQKVEMELPGDKIGLHLRGGYIFPTQQPNTTTLASRKNPLGLIIALDENKEAKGELFWDNGETKDTVANKVYLLCEFSVTQNRLEVNISQSTYKDPNNLAFNEIKILGTEEPSNVTVKHNGVPSQTSPTVTYDSNLKVAIITDIDLLLGEAYTVEWSIKIRDEEKIDCYPDENGASAENCTARGCIWEASNSSGVPFCYFVNDLYSVSDVQYNSHGATADISLKSSVYANAFPSTPVNPLRLDVTYHKNEMLQFKIYDPNKNRYEVPVPLNIPSMPSSTPEGQLYDVLIKKNPFGIEIRRKSTGTIIWDSQLLGFTFSDMFIRISTRLPSKYLYGFGETEHRSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEIASLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPHLESRDRGLSSKTLCMESQQILPDGSLVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDVAFVNISRTVLQTRYTLLPYLYTLMHKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRQKFMGFKIALDDEGTAGGWLFWDDGQSIDTYGKGLYYLASFSASQNTMQSHIIFNNYITGTNPLKLGYIEIWGVGSVPVTSVSISVSGMVITPSFNNDPTTQVLSIDVTDRNISLHNFTSLTWISTL

SEQ ID NO: 48938 - protein, 2515 aa, Homo sapiens
  Payload ID: 9809
  Gene Symbol: MGAM2
  Gene Name: maltase-glucoamylase 2 (putative)
  Uniprot ID: Q2M2H8
  ENSP ID: ENSP00000420449
MARKLSVLEVLLIIFCLIVVTIDILLLLLVLEETSDTSFTPECPEIPQSERIDCTPDQEVTEDICRWQYKCCWSPVADANVPRCFFPWNWGYEASNGHTNTSTGFTAQLKRLPSPSLFGNDVATTLFTAEYQTSNRFHFKITDFNNIRYEVSHENINLVDGIADASNLSYYVEVTDKPFSIKIMRTSNRRVLLDTSIGPLQFAQQYLQLSFRLPSANVYGLGEHVHQQYRHNMTWKTWPIFTRDATPTEGMINLYGAHTFFLCLEDARGSSFGVFLMNSNAMEVTLQPAPAITYRTIGGILDFYVFLGNTPEQVVQEYLELVGRPFFPPYWSLGFQLSRRDYGGINKLKEVVSRNRLAEIPYDVQYSDIDYMDGKKDFTVDEVAYSGLPDFVKELHDNGQKYLIIMNPGISKNSNYEPYNNGSLKRVWILGSNGFAVGEGYPGPTVFPDYTNPVCTEWWTDQVAKFHDHLEFDGVWIEMNEVSSLLQASNNQCESNNLNFPPFLPRVLDHLLFARTLCMDTEFHGGLHYDIHSLYGHSMARTTNLALETIFMNNRSFILSRSTFAGSGKFAAHWLGDNAATWDDLRWSIPTILEFNLFGIPMVGANICGYNNNVTEELCRRWMQLGAFYPLPRNHNGPGFRDQDPAAFGVDSLLLKSSRHYLNIRYTLLPYLYTLFYHAHTRGETVARPLVHEFYQDSATWDVHEQFLWGPGLLITPVLYEGVDEVKAYIPDATWYDYETGVAISWRKQLVNMLLPGDKIGLHLRGGYIFPTQKPNTTTEASRRNSLGLIIALDYKREAKGELYWDDGVSKDAVTEKKYILYDFSVTSNHLQAKIINNNYMDTDNLMFTDITILGMDKQPANFIVLLNNVATSSPSVVYNASTKVVTITDLQGLVLGQEFSIRWNLPVSDLEKFNCYPDDPTASEESCRQRGCLWEDTSTPGVPTCYYDTIPNYVASDIQYLNTSITADLSLPMAPESAAAAASDSLSAKISFLHLKVIYHTATMLQVKIYDPTNKRYEVPVPLNTPPQPVGDPENRLYDVRIQNNPFGIQIQRKNSSTVIWDSQLPGFIFNDMFLSISTRLPSQYIYGFGETEHTTFRRNMNWNTWGMFAHDEPPAYKKNSYGVHPYYMALEEDGSAHGVLLLNSNAMDVTLQPTPALTYRTTGGILDFYIVLGPTPELVTQQYTELIGRPAMIPYWALGFHLSRYGYQNDAEISSLYDAMVAAQIPYDVQHVDIDYMNRKLDFTLSANFQNLSLLIEQMKKNGMRFILILDPAISGNETQYLPFIRGQENNVFIKWPDTNDIVWGKVWPDLPNVIVDGSLDHETQVKLYRAYVAFPDFFRNSTAAWWKKEIEELYANPREPEKSLKFDGLWIDMNEPSNFVDGSVRGCSNEMLNNPPYMPYLESRDKGLSSKTLCMESQQILPDSSPVEHYNVHNLYGWSQTRPTYEAVQEVTGQRGVIITRSTFPSSGRWGGHRLGNNTAAWDQLGKSIIGMMEFSLFGIPYTGADICGFFGDAEYEMCVRWMQLGAFYPFSRNHNNIGTRRQDPVAWNSTFEMLSRKVLETRYTLLPYLYTLMHKAHVEGSTVVRPLLHEFTDDRTTWDIDRQFMLGPAILISPVLETSTFEISAYFPRARWYDYSTGTSSTSTGQRKILKAPLDHINLHVRGGYILPWQEPAMNTHSSRQNFMGLIVALDDNGTAEGQVFWDDGQSIDTYENGNYFLANFIAAQNILQIQTIHNKYLSDSNPLKVGYIRIWGVNTYVTQVSFTYDNRQFMETNFKSEPYNQILTIQLTDKTINLEKLTEVTWIDGGPVLPTPTKTSTIPMSSHPSPSTTNATSSETITSSASANTTTGTTDTVPITTTSFPSTTSVTTNTTVPDTTSPFPTSTTNASTNATVPITTTPFPTSTIGVTTNATVPNTTAPFPTNASTASTNATVPITTTCFATSTIGVTTNATVPDTTAPFPTNTTTASTNATIPITTTPFATSTISVTTSTTVPDTTAPFPTSTTSASTNATPVPITTTLFATSTIGVTTGTTVPDTTAPFPTSTTSTSTSATVPITTTPSPTNTADANTSNTVPNTTMPSPTSSTTVSTIATVPISVTPSLTSTADATISTTVLIATTSSLTGTTDVSTSTTINNISTPVQTNTTNASTSTNVANITATSHTSTDDTVPNNTVPVTAIPSLANTGVDTTSNSFSIMTTSFSESTNAMNTTVIMATTSPTSTDVASTNNDASMTNFLLATMSAGNITSNSISITTTSFGNSVPFVTTPSPSTDATTTSNNTNPGMTTYYQTSPTIPTHTLTSIPSSITSILSMFPTSNTFTTDKITNFTTPTNANTIIFNTLDTKSTMVIDATVTTTSTKDNTMSPDTTVTSIDKFTTHITQFATPHSATTTTLALSHTSLAPTNLSNLGTMDITDADNSSSVTGNTTHISVSNLTTASVTITATGLDSQTPHMVINSVATYLPITATSATTDTTNITKYALNTTTPDSTVHTSATAPTYIANAINATQVP

SEQ ID NO: 48939 - protein, 482 aa, Homo sapiens
  Payload ID: 9809
  Gene Symbol: MGAM2
  Gene Name: maltase-glucoamylase 2 (putative)
  Uniprot ID: Q2M2H8
  ENSP ID: ENSP00000447431
MARKLSVLEVLLIIFCLIVVTIDILLLLLVLEETSDTSFTPECPEIPQSERIDCTPDQEVTEDICRWQYKCCWSPVADANVPRCFFPWNWGYEASNGHTNTSTGFTAQLKRLPSPSLFGNDVATTLFTAEYQTSNRFHFKITDFNNIRYEVSHENINLVDGIADASNLSYYVEVTDKPFSIKIMRTSNRRVLLDTSIGPLQFAQQYLQLSFRLPSANVYGLGEHVHQQYRHNMTWKTWPIFTRDATPTEGMINLYGAHTFFLCLEDARGSSFGVFLMNSNAMEVTLQPAPAITYRTIGGILDFYVFLGNTPEQVVQEYLELVGRPFFPPYWSLGFQLSRRDYGGINKLKEVVSRNRLAEIPYDVQYSDIDYMDGKKDFTVDEVAYSGLPDFVKELHDNGQKYLIIMNPGISKNSNYEPYNNGSLKRVWILGSNGFAVGEGYPGPTVFPDYTNPVCTEWWTDQVAKFHDHLEFDGVWIVSYYS

SEQ ID NO: 48940 - protein, 482 aa, Homo sapiens; identical to SEQ ID NO: 48939
  Payload ID: 9809
  Gene Symbol: MGAM2
  Gene Name: maltase-glucoamylase 2 (putative)
  Uniprot ID: Q2M2H8
  ENSP ID: ENSP00000484330

SEQ ID NO: 48941 - protein, 2515 aa, Homo sapiens; identical to SEQ ID NO: 48938
  Payload ID: 9809
  Gene Symbol: MGAM2
  Gene Name: maltase-glucoamylase 2 (putative)
  Uniprot ID: Q2M2H8
  ENSP ID: ENSP00000488423

SEQ ID NO: 48942 - protein, 507 aa, Homo sapiens
  Payload ID: 9810
  Gene Symbol: MALRD1
  Gene Name: MAM and LDL receptor class A domain containing 1
  ENSP ID: ENSP00000366476
  MOD_RES (1)..(1): Any amino acid
XECPRGRSALLKGPPQEKPNRRSALLSVGEISELCPEITDFLCRDKKCIASHLLCDYKPDCSDRSDEAHCAHYTSTTGSCNFETSSGNWTTACSLTQDSEDDLDWAIGSRIPAKALIPDSDHTPGSGQHFLYVNSSGSKEGSVARITTSKSFPASLGMCTVRFWFYMIDPRSMGILKVYTIEESGLNILVWSVIGNKRTGWTYGSVPLSSNSPFKVAFEADLDGNEDIFIALDDISFTPECVTGGPVPVQPSPCEADQFSCIYTLQCVPLSGKCDGHEDCIDGSDEMDCPLSPTPPLCSNMEFPCSTDECIPSLLLCDGVPDCHFNEDELICSNKSCSNGALVCASSNSCIPAHQRCDGFADCMDFQLDESSCSECPLNYCRNGGTCVVEKNGPMCRCRQGWKGNRCHIKFNPPATDFTYAQNNTWTLLGIGLAFLMTHITVAVLCFLANRKVPIRKTEGSGNCAFVNPVYGNWSNPEKTESSVYSFSNPLYGTTSGSLETLSHHLK

SEQ ID NO: 48943 - protein, 1486 aa, Homo sapiens
  Payload ID: 9810
  Gene Symbol: MALRD1
  Gene Name: MAM and LDL receptor class A domain containing 1
  ENSP ID: ENSP00000366477
PRDHSLNASQGHFMFILKKSSSLWQVAKLQSPTFSQTGPGCILSFWFYNYGLSVGAAELQLHMENSHDSTVIWRVLYNQGKQWLEATIQLGRLSQPFHLSLDKVSLGIYDGVSAIDDIRFENCTLPLPAESCEGLDHFWCRHTRACIEKLRLCDLVDDCGDRTDEVNCAPELQCNFETGICNWEQDAKDDFDWTRSQGPTPTLNTGPMKDNTLGTAKGHYLYIESSEPQAFQDSAALLSPILNATDTKGCTFRFYYHMFGKRIYRLAIYQRIWSDSRGQLLWQIFGNQGNRWIRKHLNISSRQPFQILVEASVGDGFTGDIAIDDLSFMDCTLYPGNLPADLPTPPETSVPVTLPPHNCTDNEFICRSDGHCIEKMQKCDFKYDCPDKSDEASCVMEVCSFEKRSLCKWYQPIPVHLLQDSNTFRWGLGNGISIHHGEENHRPSVDHTQNTTDGWYLYADSSNGKFGDTADILTPIISLTGPKCTLVFWTHMNGATVGSLQVLIKKDNVTSKLWAQTGQQGAQWKRAEVFLGIRSHTQIVFRAKRGISYIGDVAVDDISFQDCSPLLSPERKCTDHEFMCANKHCIAKDKLCDFVNDCADNSDETTFICRTSSGRCDFEFDLCSWKQEKDEDFDWNLKASSIPAAGTEPAADHTLGNSSGHYIFIKSLFPQQPMRAARISSPVISKRSKNCKIIFHYHMYGNGIGALTLMQVSVTNQTKVLLNLTVEQGNFWRREELSLFGDEDFQLKFEGRVGKGQRGDIALDDIVLTENCLSLHDSVQEELAVPLPTGFCPLGYRECHNGKCYRLEQSCNFVDNCGDNTDENECGSSCTFEKGWCGWQNSQADNFDWVLGVGSHQSLRPPKDHTLGNENAILLMRRHKYPIRSVNLHTVKHVLKAQTVGNCSVSKLEARLLDFLSVPNENTFGSSDHTNWHFMYLEATAVGLRGDKAHFRSTMWRESSAACTMSFWYFVSAKATGSIQILIKRGRRRRRAPNPVLSGSPTIPRQGSQQLGGWRGGSARHRARAFPEPECPRGRSALLKGPPQEKPNRRSALLSVGEISELCPEITDFLCRDKKCIASHLLCDYKPDCSDRSDEAHCAHYTSTTGSCNFETSSGNWTTACSLTQDSEDDLDWAIGSRIPAKALIPDSDHTPGSGQHFLYVNSSGSKEGSVARITTSKSFPASLGMCTVRFWFYMIDPRSMGILKVYTIEESGLNILVWSVIGNKRTGWTYGSVPLSSNSPFKVAFEADLDGNEDIFIALDDISFTPECVTGGPVPVQPSPCEADQFSCIYTLQCVPLSGKCDGHEDCIDGSDEMDCPLSPTPPLCSNMEFPCSTDECIPSLLLCDGVPDCHFNEDELICSNKSCSNGALVCASSNSCIPAHQRCDGFADCMDFQLDESSCSDTWTLLGIGLAFLMTHITVAVLCFLANRKVPIRKTEGSGNCAFVNPVYGNWSNPEKTESSVYSFSNPLYGTTSGSLETLSHHLK

SEQ ID NO: 48944 - protein, 66 aa, Homo sapiens
  Payload ID: 9810
  Gene Symbol: MALRD1
  Gene Name: MAM and LDL receptor class A domain containing 1
  ENSP ID: ENSP00000403218
NTFMKISVLARQHVSQKFLTNNNLKMYYEFCLFLLKPIIWHNIRKPGDPVTSSQIAASRPSLIQHV

SEQ ID NO: 48945 - protein, 258 aa, Homo sapiens
  Payload ID: 9810
  Gene Symbol: MALRD1
  Gene Name: MAM and LDL receptor class A domain containing 1
  ENSP ID: ENSP00000404330
LKFEGRVGKGQRGDIALDDIVLTENCLSLHDSVQEELAVPLPTGFCPLGYRECHNGKCYRLEQSCNFVDNCGDNTDENECGSSCTFEKGWCGWQNSQADNFDWVLGVGSHQSLRPPKDHTLGNENGHFMYLEATAVGLRGDKAHFRSTMWRESSAACTMSFWYFVSAKATGSIQILIKTEKGLSKVWQESKQNPGNHWQKADILLGKLRNFEVIFQGIRTRDLGGGAAIDDIEFKNCTTVGEISELCPEITDFLCRDK

SEQ ID NO: 48946 - protein, 2156 aa, Homo sapiens
  Payload ID: 9810
  Gene Symbol: MALRD1
  Gene Name: MAM and LDL receptor class A domain containing 1
  Uniprot ID: Q5VYJ5
  ENSP ID: ENSP00000412763
MLFFLDRMLAFPMNETFCCLWIACVFNSTLAQQGTESFQCDNGVSLPPDSICDFTDQCGDSSDERHCLNYERCDFEDGLCHMTQDQSLQPSWTKRSGMIGLSPPFYDHNGDVSAHFLSLVSRVDSISSSLRSRVFLPTNDQHDCQITFYYFSCQVSGKLMVGLQTACGGPIQHLWQNTAALPNQWERNVIKIQSSQRFQVVFEGQMASTYEQDEVIAIDDISFSSGCLPANDGILLCQEALNAERELCHPDTDLCRFDATDEELRLCQACGFEFDMCEWTSEASAGQISWMRTKAREIPAFESTPQQDQGGDDEGYYVWVGAKHGFTLNHLDSRAYLNSSVCHCLGKSCHLQFYYAMESSVLRVRLYNNKEEEIFWTYNISTHSQWVKADVLIPEDLKTFKIIFEGTLLSQRSFIALDHLWVYACGQTQSRKLCSADEFPCTSGQCIAKESVCDSRQDCSDESDEDPATCSKHLTCDFESGFCGWEPFLTEDSHWKLMKGLNNGEHHFPAADHTANINHGSFIYLEAQRSPGVAKLGSPVLTKLLTASTPCQVQFWYHLSQHSNLSVFTRTSLDGNLQKQGKIIRFSESQWSHAKIDLIAEAGESTLPFQLILEATVLSSNATVALDDISVSQECEISYKSLPRTSTQSKFSKCDFEANSCDWFEAISGDHFDWIRSSQSELSADFEHQAPPRDHSLNASQGHFMFILKKSSSLWQVAKLQSPTFSQTGPGCILSFWFYNYGLSVGAAELQLHMENSHDSTVIWRVLYNQGKQWLEATIQLGRLSQPFHLSLDKVSLGIYDGVSAIDDIRFENCTLPLPAESCEGLDHFWCRHTRACIEKLRLCDLVDDCGDRTDEVNCAPELQCNFETGICNWEQDAKDDFDWTRSQGPTPTLNTGPMKDNTLGTAKGHYLYIESSEPQAFQDSAALLSPILNATDTKGCTFRFYYHMFGKRIYRLAIYQRIWSDSRGQLLWQIFGNQGNRWIRKHLNISSRQPFQILVEASVGDGFTGDIAIDDLSFMDCTLYPGNLPADLPTPPETSVPVTLPPHNCTDNEFICRSDGHCIEKMQKCDFKYDCPDKSDEASCVMEVCSFEKRSLCKWYQPIPVHLLQDSNTFRWGLGNGISIHHGEENHRPSVDHTQNTTDGWYLYADSSNGKFGDTADILTPIISLTGPKCTLVFWTHMNGATVGSLQVLIKKDNVTSKLWAQTGQQGAQWKRAEVFLGIRSHTQIVFRAKRGISYIGDVAVDDISFQDCSPLLSPERKCTDHEFMCANKHCIAKDKLCDFVNDCADNSDETTFICRTSSGRCDFEFDLCSWKQEKDEDFDWNLKASSIPAAGTEPAADHTLGNSSGHYIFIKSLFPQQPMRAARISSPVISKRSKNCKIIFHYHMYGNGIGALTLMQVSVTNQTKVLLNLTVEQGNFWRREELSLFGDEDFQLKFEGRVGKGQRGDIALDDIVLTENCLSLHDSVQEELAVPLPTGFCPLGYRECHNGKCYRLEQSCNFVDNCGDNTDENECGSSCTFEKGWCGWQNSQADNFDWVLGVGSHQSLRPPKDHTLGNENGHFMYLEATAVGLRGDKAHFRSTMWRESSAACTMSFWYFVSAKATGSIQILIKTEKGLSKVWQESKQNPGNHWQKADILLGKLRNFEVIFQGIRTRDLGGGAAIDDIEFKNCTTVGEISELCPEITDFLCRDKKCIASHLLCDYKPDCSDRSDEAHCAHYTSTTGSCNFETSSGNWTTACSLTQDSEDDLDWAIGSRIPAKALIPDSDHTPGSGQHFLYVNSSGSKEGSVARITTSKSFPASLGMCTVRFWFYMIDPRSMGILKVYTIEESGLNILVWSVIGNKRTGWTYGSVPLSSNSPFKVAFEADLDGNEDIFIALDDISFTPECVTGGPVPVQPSPCEADQFSCIYTLQCVPLSGKCDGHEDCIDGSDEMDCPLSPTPPLCSNMEFPCSTDECIPSLLLCDGVPDCHFNEDELICSNKSCSNGALVCASSNSCIPAHQRCDGFADCMDFQLDESSCSECPLNYCRNGGTCVVEKNGPMCRCRQGWKGNRCHIKFNPPATDFTYAQNNTWTLLGIGLAFLMTHITVAVLCFLANRKVPIRKTEGSGNCAFVNPVYGNWSNPEKTESSVYSFSNPLYGTTSGSLETLSHHLK

SEQ ID NO: 48947 - protein, 686 aa, Homo sapiens
  Payload ID: 9811
  Gene Symbol: MAMDC2
  Gene Name: MAM domain containing 2
  Uniprot ID: Q7Z304
  ENSP ID: ENSP00000366387
MLLRGVLLALQALQLAGALDLPAGSCAFEESTCGFDSVLASLPWILNEEGHYIYVDTSFGKQGEKAVLLSPDLQAEEWSCLRLVYQITTSSESLSDPSQLNLYMRFEDESFDRLLWSAKEPSDSWLIASLDLQNSSKKFKILIEGVLGQGNTASIALFEIKMTTGYCIECDFEENHLCGFVNRWNPNVNWFVGGGSIRNVHSILPQDHTFKSELGHYMYVDSVYVKHFQEVAQLISPLTTAPMAGCLSFYYQIQQGNDNVFSLYTRDVAGLYEEIWKADRPGNAAWNLAEVEFSAPYPMEVIFEVAFNGPKGGYVALDDISFSPVHCQNQTELLFSAVEASCNFEQDLCNFYQDKEGPGWTRVKVKPNMYRAGDHTTGLGYYLLANTKFTSQPGYIGRLYGPSLPGNLQYCLRFHYAIYGFLKMSDTLAVYIFEENHVVQEKIWSVLESPRGVWMQAEITFKKPMPTKVVFMSLCKSFWDCGLVALDDITIQLGSCSSSEKLPPPPGECTFEQDECTFTQEKRNRSSWHRRRGETPTSYTGPKGDHTTGVGYYMYIEASHMVYGQKARLLSRPLRGVSGKHCLTFFYHMYGGGTGLLSVYLKKEEDSEESLLWRRRGEQSISWLRALIEYSCERQHQIIFEAIRGVSIRSDIAIDDVKFQAGPCGEMEDTTQQSSGYSEDLNEIEY

SEQ ID NO: 48948 - protein, 549 aa, Homo sapiens
  Payload ID: 9811
  Gene Symbol: MAMDC2
  Gene Name: MAM domain containing 2
  ENSP ID: ENSP00000485495
MLLRGVLLALQALQLAGALDLPAGSCAFEESTCGFDSVLASLPWILNEEGHYIYVDTSFGKQGEKAVLLSPDLQAEEWSCLRLVYQITTSSESLSDPSQLNLYMRFEDESFDRLLWSAKEPSDSWLIASLDLQNSSKKFKILIEGVLGQGNTASIALFEIKMTTGYCIECDFEENHLCGFVNRWNPNVNWFVGGGSIRNVHSILPQDHTFKSELGHYMYVDSVYVKHFQEVAQLISPLTTAPMAGCLSFYYQIQQGNDNVFSLYTRDVAGLYEEIWKADRPGNAAWNLAEVEFSAPYPMEVIFEVAFNGPKGGYVALDDISFSPVHCQNQTELLFSAVEASCNFEQDLCNFYQDEGPGWTRVKVKPNMYRAGDHTTGLGYYLLANTKFTSQPGYIGRLYGPSLPGNLQYCLRFHYAIYGFLKMSDTLAVYIFEENHVVQEKIWSVLESPRGVWMQAEITFKKPMPTKVVFMSLCKSFWDCGLVALDDITIQLGSCSSSEKLPPPPGECTFEQDECTFTQEKRNRSSWHRRRGETPTSYTGPKGDHTTGV

SEQ ID NO: 48949 - protein, 1137 aa, Homo sapiens
  Payload ID: 9812
  Gene Symbol: MAMDC4
  Gene Name: MAM domain containing 4
  Uniprot ID: Q6UXC1
  ENSP ID: ENSP00000319388
MPLSSHLLPALVLFLAGSSGWAWVPNHCRSPGQAVCNFVCDCRDCSDEAQCGYHGASPTLGAPFACDFEQDPCGWRDISTSGYSWLRDRAGAALEGPGPHSDHTLGTDLGWYMAVGTHRGKEASTAALRSPTLREAASSCKLRLWYHAASGDVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRAGGPERPSWPRRDHSRNSAQGSFLVSVAEPGTPAILSSPEFQASGTSNCSLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPREVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAERAWRVVFEAVAAGVAHSYVALDDLLLQDGPCPQPGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 48950 - protein, 1216 aa, Homo sapiens
  Payload ID: 9812
  Gene Symbol: MAMDC4
  Gene Name: MAM domain containing 4
  Uniprot ID: Q6UXC1
  ENSP ID: ENSP00000411339
MPLSSHLLPALVLFLAGSSGWAWVPNHCRSPGQAVCNFVCDCRDCSDEAQCGYHGASPTLGAPFACDFEQDPCGWRDISTSGYSWLRDRAGAALEGPGPHSDHTLGTDLGWYMAVGTHRGKEASTAALRSPTLREAASSCKLRLWYHAASGDVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRAGGPERPSWPRRDHSRNSAQGSFLVSVAEPGTPAILSSPEFQASGTSNCSLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRGFLALVVVDNGSRELAWQALSSSAGIWKVDKVLLGARRRPFRLEFVGLVDLDGPDQQGAGVDNVTLRDCSPTVTTERDREVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAERAWRVVFEAVAAGVAHSYVALDDLLLQDGPCPQPGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 48951 - protein, 236 aa, Homo sapiens
  Payload ID: 9812
  Gene Symbol: MAMDC4
  Gene Name: MAM domain containing 4
  ENSP ID: ENSP00000435513
LSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAERAWRVSAGWGAPPPPPPPRAAWTR

SEQ ID NO: 48952 - protein, 159 aa, Homo sapiens
  Payload ID: 9813
  Gene Symbol: MDGA1
  Gene Name: MAM domain containing glycosylphosphatidylinositol anchor 1
  ENSP ID: ENSP00000393330
  MOD_RES (1)..(1): Any amino acid
XNQHNAVVKAIPVRRVEKGQLLEYILTDLRVPHSYEVRLTPYTTFGAGDMASRIIHYTEHNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLN

SEQ ID NO: 48953 - protein, 955 aa, Homo sapiens
  Payload ID: 9813
  Gene Symbol: MDGA1
  Gene Name: MAM domain containing glycosylphosphatidylinositol anchor 1
  Uniprot ID: Q8NFP4
  ENSP ID: ENSP00000402584
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVDIYEPLYTQGETKVLKLKNLRPQDYASYTCQVSVRNVCGIPDKAITFRLTNTTAPPALKLSVNETLVVNPGENVTVQCLLTGGDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQREPDAVDPVLNYRLSIRQLNQHNAVVKAIPVRRVEKGQLLEYILTDLRVPHSYEVRLTPYTTFGAGDMASRIIHYTEPINSPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKVVVMPGSGAPCQSSPQLWGPMAIFLLALQR

SEQ ID NO: 48954 - protein, 129 aa, Homo sapiens
  Payload ID: 9813
  Gene Symbol: MDGA1
  Gene Name: MAM domain containing glycosylphosphatidylinositol anchor 1
  ENSP ID: ENSP00000421510
MLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVD

SEQ ID NO: 48955 - protein, 973 aa, Homo sapiens
  Payload ID: 9813
  Gene Symbol: MDGA1
  Gene Name: MAM domain containing glycosylphosphatidylinositol anchor 1
  Uniprot ID: Q8NFP4
  ENSP ID: ENSP00000422042
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVDIYEPLYTQGETKVLKLKNLRPQDYASYTCQVSVRNVCGIPDKAITFRLTNTTAPPALKLSVNETLVVNPGENVTVQCLLTGGDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQREPDAVDPVLNYRLSIRQLNQHNAVVKAIPVRRVEKGQLLEYILTDLRVPHSYEVRLTPYTTFGAGDMASRIIHYTEPINSPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKGARREGGGGAESGGSCAWRGFLSVEGGCLGLNRGSECLSDGNHVALTV

SEQ ID NO: 48956 - protein, 87 aa, Homo sapiens
  Payload ID: 9813
  Gene Symbol: MDGA1
  Gene Name: MAM domain containing glycosylphosphatidylinositol anchor 1
  ENSP ID: ENSP00000425911
  MOD_RES (1)..(1): Any amino acid
XHKLSKNYSYVLQWTQREPDAVDPVLNYRLSIRQLNQHNAVVKAIPVRRVEKGQLLEYILTDLRVPHSYETTPATLRMRRSVAIPRT

SEQ ID NO: 48957 - protein, 77 aa, Homo sapiens
  Payload ID: 9813
  Gene Symbol: MDGA1
  Gene Name: MAM domain containing glycosylphosphatidylinositol anchor 1
  ENSP ID: ENSP00000427645
MLQCLVTGHPRPQVRWTKTAGSASDKFQETSVFNETLRIERIARTQGGRYYCKAENGVGVPAIKSIRVDVQYLDEPM

SEQ ID NO: 48958 - protein, 727 aa, Homo sapiens
  Payload ID: 9814
  Gene Symbol: MDGA2
  Gene Name: MAM domain containing glycosylphosphatidylinositol anchor 2
  Uniprot ID: Q7Z553
  ENSP ID: ENSP00000349925
MVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWSRADKEVAMPDGSMQMESYDGTLRIVNVSREMSGMYRCQTSQYNGFNVKPREALVQLIVQYPPAVEPAFLEIRQGQDRSVTMSCRVLRAYPIRVLTYEWRLGNKLLRTGQFDSQEYTEYAVKSLSNENYGVYNCSIINEAGAGRCSFLVTGKAYAPEFYYDTYNPVWQNRHRVYSYSLQWTQMNPDAVDRIVAYRLGIRQAGQQRWWEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 48959 - protein, 956 aa, Homo sapiens
  Payload ID: 9814
  Gene Symbol: MDGA2
  Gene Name: MAM domain containing glycosylphosphatidylinositol anchor 2
  Uniprot ID: Q7Z553
  ENSP ID: ENSP00000382178
MDLLYGLVWLLTVLLEGISGQGVYAPPTVRIVHSGLACNIEEERYSERVYTIREGETLELTCLVTGHPRPQIRWTKTAGSASDRFQDSSVFNETLRITNIQRHQGGRYYCKAENGLGSPAIKSIRVDVYYLDDPVVTVHQSIGEAKEQFYYERTVFLRCVANSNPPVRYSWRRGQEVLLQGSDKGVEIYEPFFTQGETKILKLKNLRPQDYANYSCIASVRNVCNIPDKMVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWSRADKEVAMPDGSMQMESYDGTLRIVNVSREMSGMYRCQTSQYNGFNVKPREALVQLIVQYPPAVEPAFLEIRQGQDRSVTMSCRVLRAYPIRVLTYEWRLGNKLLRTGQFDSQEYTEYAVKSLSNENYGVYNCSIINEAGAGRCSFLVTGKAYAPEFYYDTYNPVWQNRHRVYSYSLQWTQMNPDAVDRIVAYRLGIRQAGQQRWWEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 48960 - protein, 826 aa, Homo sapiens
  Payload ID: 9814
  Gene Symbol: MDGA2
  Gene Name: MAM domain containing glycosylphosphatidylinositol anchor 2
  ENSP ID: ENSP00000405456
LDDPVVTVHQSIGEAKEQFYYERTVFLRCVANSNPPVRYSWRRGQEVLLQGSDKGVEIYEPFFTQGETKILKLKNLRPQDYANYSCIASVRNVCNIPDKMVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWSRADKEVAMPDGSMQMESYDGTLRIVNVSREMSGMYRCQTSQYNGFNVKPREALVQLIVQYPPAVEPAFLEIRQGQDRSVTMSCRVLRAYPIRVLTYEWRLGNKLLRTGQFDSQEYTEYAVKSLSNENYGVYNCSIINEAGAGRCSFLVTGKAYAPEFYYDTYNPVWQNRHRVYSYSLQWTQMNPDAVDRIVAYRLGIRQAGQQRWWEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 48961 - protein, 250 aa, Homo sapiens
  Payload ID: 9814
  Gene Symbol: MDGA2
  Gene Name: MAM domain containing glycosylphosphatidylinositol anchor 2
  ENSP ID: ENSP00000434991
MVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTGNTIGDKRNILTSSKTLPLESTHLTTDRCGFSIEWKLYKV

SEQ ID NO: 48962 - protein, 253 aa, Homo sapiens
  Payload ID: 9814
  Gene Symbol: MDGA2
  Gene Name: MAM domain containing glycosylphosphatidylinositol anchor 2
  ENSP ID: ENSP00000450827
  MOD_RES (1)..(1): Any amino acid
XKILKLKNLRPQDYANYSCIASVRNVCNIPDKMVSFRLSNKTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWS

SEQ ID NO: 48963 - protein, 142 aa, Homo sapiens
  Payload ID: 9814
  Gene Symbol: MDGA2
  Gene Name: MAM domain containing glycosylphosphatidylinositol anchor 2
  ENSP ID: ENSP00000452515
MFKYESLGICRRTHGSAACFSHSVADSPEVAFCQAKLPFLPPTTVTSEAPPTVRIVHSGLACNIEEERYSERVYTIREGETLELTCLVTGHPRPQIRWTKTAGSASDRFQDSSVFNETLRITNIQRHQGGRYYCKAENGLGS

SEQ ID NO: 48964 - protein, 233 aa, Homo sapiens
  Payload ID: 9814
  Gene Symbol: MDGA2
  Gene Name: MAM domain containing glycosylphosphatidylinositol anchor 2
  ENSP ID: ENSP00000452593
MVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTGKITIGHQRRRHNRTAMSSNWQT

SEQ ID NO: 48965 - protein, 380 aa, Homo sapiens
  Payload ID: 9815
  Gene Symbol: MASP1
  Gene Name: mannan-binding lectin serine peptidase 1 (C4/C2 activating component of Ra-reactive factor)
  Uniprot ID: P48740
  ENSP ID: ENSP00000169293
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 48966 - protein, 728 aa, Homo sapiens
  Payload ID: 9815
  Gene Symbol: MASP1
  Gene Name: mannan-binding lectin serine peptidase 1 (C4/C2 activating component of Ra-reactive factor)
  Uniprot ID: P48740
  ENSP ID: ENSP00000296280
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 48967 - protein, 699 aa, Homo sapiens
  Payload ID: 9815
  Gene Symbol: MASP1
  Gene Name: mannan-binding lectin serine peptidase 1 (C4/C2 activating component of Ra-reactive factor)
  Uniprot ID: P48740
  ENSP ID: ENSP00000336792
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPEDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 48968 - protein, 354 aa, Homo sapiens
  Payload ID: 9815
  Gene Symbol: MASP1
  Gene Name: mannan-binding lectin serine peptidase 1 (C4/C2 activating component of Ra-reactive factor)
  ENSP ID: ENSP00000376262
MFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 48969 - protein, 615 aa, Homo sapiens
  Payload ID: 9815
  Gene Symbol: MASP1
  Gene Name: mannan-binding lectin serine peptidase 1 (C4/C2 activating component of Ra-reactive factor)
  Uniprot ID: P48740
  ENSP ID: ENSP00000376264
MSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 48970 - protein, 204 aa, Homo sapiens
  Payload ID: 9815
  Gene Symbol: MASP1
  Gene Name: mannan-binding lectin serine peptidase 1 (C4/C2 activating component of Ra-reactive factor)
  ENSP ID: ENSP00000376267
MRPTFMSFRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVI

SEQ ID NO: 48971 - protein, 55 aa, Homo sapiens
  Payload ID: 9815
  Gene Symbol: MASP1
  Gene Name: mannan-binding lectin serine peptidase 1 (C4/C2 activating component of Ra-reactive factor)
  ENSP ID: ENSP00000409047
MFGQIQSPGYPDSYPSDSEVTWNITVPDGFRIKLYFMHFNLESSYLCEYDYVKVE

SEQ ID NO: 48972 - protein, 118 aa, Homo sapiens
  Payload ID: 9815
  Gene Symbol: MASP1
  Gene Name: mannan-binding lectin serine peptidase 1 (C4/C2 activating component of Ra-reactive factor)
  ENSP ID: ENSP00000412021
MPANSRDTQGPQNKDKASRTPHRARAHRWLLLYYALCFSLSKASAHTVELNNMFGQIQSPGYPDSYPSDSEVTWNITVPDGFRIKLYFMHFNLESSYLCEYDYVKVETEDQVLATFCG

SEQ ID NO: 48973 - protein, 686 aa, Homo sapiens
  Payload ID: 9816
  Gene Symbol: MASP2
  Gene Name: mannan-binding lectin serine peptidase 2
  Uniprot ID: O00187
  ENSP ID: ENSP00000383690
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSALCSGQVFTQRSGELSSPEYPRPYPKLSSCTYSISLEEGFSVILDFVESFDVETHPETLCPYDFLKIQTDREEHGPFCGKTLPHRIETKSNTVTITFVTDESGDHTGWKIHYTSTAQPCPYPMAPPNGHVSPVQAKYILKDSFSIFCETGYELLQGHLPLKSFTAVCQKDGSWDRPMPACSIVDCGPPDDLPSGRVEYITGPGVTTYKAVIQYSCEETFYTMKVNDGKYVCEADGFWTSSKGEKSLPVCEPVCGLSARTTGGRIYGGQKAKPGDFPWQVLILGGTTAAGALLYDNWVLTAAHAVYEQKHDASALDIRMGTLKRLSPHYTQAWSEAVFIHEGYTHDAGFDNDIALIKLNNKVVINSNITPICLPRKEAESFMRTDDIGTASGWGLTQRGFLARNLMYVDIPIVDHQKCTAAYEKPPYPRGSVTANMLCAGLESGGKDSCRGDSGGALVFLDSETERWFVGGIVSWGSMNCGEAGQYGVYTKVINYIPWIENIISDF

SEQ ID NO: 48974 - protein, 185 aa, Homo sapiens
  Payload ID: 9816
  Gene Symbol: MASP2
  Gene Name: mannan-binding lectin serine peptidase 2
  Uniprot ID: O00187
  ENSP ID: ENSP00000383691
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSEQSL

SEQ ID NO: 48975 - protein, 362 aa, Homo sapiens
  Payload ID: 9817
  Gene Symbol: MPI
  Gene Name: mannose phosphate isomerase
  Uniprot ID: P34949
  ENSP ID: ENSP00000318192
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKTAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVPGSVTEYKVLALDSASILLMVQGTVIASTPTTQTPIPLQRGGVLFIGANESVSLKLTEPKDLLIFRACCLL

SEQ ID NO: 48976 - protein, 423 aa, Homo sapiens
  Payload ID: 9817
  Gene Symbol: MPI
  Gene Name: mannose phosphate isomerase
  Uniprot ID: P34949
  ENSP ID: ENSP00000318318
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVPGSVTEYKVLALDSASILLMVQGTVIASTPTTQTPIPLQRGGVLFIGANESVSLKLTEPKDLLIFRACCLL

SEQ ID NO: 48977 - protein, 373 aa, Homo sapiens
  Payload ID: 9817
  Gene Symbol: MPI
  Gene Name: mannose phosphate isomerase
  ENSP ID: ENSP00000440447
MGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVPGSVTEYKVLALDSASILLMVQGTVIASTPTTQTPIPLQRGGVLFIGANESVSLKLTEPKDLLIFRACCLL

SEQ ID NO: 48978 - protein, 71 aa, Homo sapiens
  Payload ID: 9817
  Gene Symbol: MPI
  Gene Name: mannose phosphate isomerase
  ENSP ID: ENSP00000454267
MAAPRGEPLAGVSASVFVERVLGTTPGIIGQVESAPGIPRKDGIPTFLCGAAVCLGEDGFQQRSGAAVGQQ

SEQ ID NO: 48979 - protein, 228 aa, Homo sapiens
  Payload ID: 9817
  Gene Symbol: MPI
  Gene Name: mannose phosphate isomerase
  ENSP ID: ENSP00000454312
MGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKTAAGNNMEDIFGELLLQLHQQYPGDIGCFAIYFLNLLTLKPGEAMFLEANVPHAYLKGGEPHFSSEPHCHPCWALFPYLDKGRRRVVKETPKDLAALTSEGSWAQQATAGRDDECI

SEQ ID NO: 48980 - protein, 264 aa, Homo sapiens
  Payload ID: 9817
  Gene Symbol: MPI
  Gene Name: mannose phosphate isomerase
  ENSP ID: ENSP00000454619
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQGGHSYIPGWVQCSGLGFPADTRLWGQFSTPLPKWNTKRGPT

SEQ ID NO: 48981 - protein, 174 aa, Homo sapiens
  Payload ID: 9817
  Gene Symbol: MPI
  Gene Name: mannose phosphate isomerase
  ENSP ID: ENSP00000454622
MAAPRVFPLSCAVQQYAWGKMGSNSEVARLLASSDPLAQIAEDKPYAEWRKSQSIGRLSPLLLKLEDLWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVE

SEQ ID NO: 48982 - protein, 185 aa, Homo sapiens
  Payload ID: 9817
  Gene Symbol: MPI
  Gene Name: mannose phosphate isomerase
  ENSP ID: ENSP00000455065
MAAPRVFPLSCAVQQYAWGKMGSNSEVARLLASSDPLAQIAEDKPYAEILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSC

SEQ ID NO: 48983 - protein, 288 aa, Homo sapiens
  Payload ID: 9817
  Gene Symbol: MPI
  Gene Name: mannose phosphate isomerase
  ENSP ID: ENSP00000455161
MGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGDCVECMACSDNTVRAGLTPKFIDVPTL

SEQ ID NO: 48984 - protein, 403 aa, Homo sapiens
  Payload ID: 9817
  Gene Symbol: MPI
  Gene Name: mannose phosphate isomerase
  ENSP ID: ENSP00000455241
MGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVPGSVTEYKVLALDSASILLMVQGTVIASTPTTQTPIPLQRGGVLFIGANESVSLKLTEPKDLLIFRACCLL

SEQ ID NO: 48985 - protein, 173 aa, Homo sapiens
  Payload ID: 9817
  Gene Symbol: MPI
  Gene Name: mannose phosphate isomerase
  ENSP ID: ENSP00000455383
MGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASS

SEQ ID NO: 48986 - protein, 287 aa, Homo sapiens
  Payload ID: 9817
  Gene Symbol: MPI
  Gene Name: mannose phosphate isomerase
  ENSP ID: ENSP00000455405
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGGPWLCH

SEQ ID NO: 48987 - protein, 119 aa, Homo sapiens
  Payload ID: 9817
  Gene Symbol: MPI
  Gene Name: mannose phosphate isomerase
  ENSP ID: ENSP00000455477
MGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMA

SEQ ID NO: 48988 - protein, 175 aa, Homo sapiens
  Payload ID: 9817
  Gene Symbol: MPI
  Gene Name: mannose phosphate isomerase
  ENSP ID: ENSP00000455972
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAPQHYPDANHKPEMAIALTPFQGLCGFRPVEEIVTFLKKVPEFQFLIGDEAATHLKQTMSHDSQA

SEQ ID NO: 48989 - protein, 213 aa, Homo sapiens
  Payload ID: 9817
  Gene Symbol: MPI
  Gene Name: mannose phosphate isomerase
  ENSP ID: ENSP00000457013
QQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKTAAGNNMEDIFGELLLQLHQQYPGDIGCFAIYFLNLLTLKPGEAMFLEANVPHAYLKGGPWLCH

SEQ ID NO: 48990 - protein, 319 aa, Homo sapiens
  Payload ID: 9817
  Gene Symbol: MPI
  Gene Name: mannose phosphate isomerase
  ENSP ID: ENSP00000457020
MGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGGEPHFSSEPHCHPCWALFPYLDKGRRRVVKETPKDLAALTSEGSWAQQATAGRDDECI

SEQ ID NO: 48991 - protein, 168 aa, Homo sapiens
  Payload ID: 9817
  Gene Symbol: MPI
  Gene Name: mannose phosphate isomerase
  ENSP ID: ENSP00000457494
MAAPRVFPLSCAVQQYAWGKMGSNSEVARLLASSDPLAQIAEDKPYAELWMGTHPRGDAKILDNRISQKTLSQWIAENQDSLGSKELAEKLHLQAPQHYPDANHKPEMAIALTPFQGLCGFRPVEEIVTFLKKVPEFQFLIGDEAATHLKQTMSHDSQAVASSLQSCF

SEQ ID NO: 48992 - protein, 125 aa, Homo sapiens
  Payload ID: 9817
  Gene Symbol: MPI
  Gene Name: mannose phosphate isomerase
  ENSP ID: ENSP00000457619
MAAPRVFPLSCAVQQYAWGKMGSNSEVARLLASSDPLAQIAEDKPYAELWMGTHPRGDAKILDNRISQKTLSQWIAENQDSLGSKVLALDSASILLMVQGTVIASTPTTQTPIPLQRGGVLFIGA

SEQ ID NO: 48993 - protein, 339 aa, Homo sapiens
  Payload ID: 9817
  Gene Symbol: MPI
  Gene Name: mannose phosphate isomerase
  ENSP ID: ENSP00000457885
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGGEPHFSSEPHCHPCWALFPYLDKGRRRVVKETPKDLAALTSEGSWAQQATAGRDDECI

SEQ ID NO: 48994 - protein, 1456 aa, Homo sapiens [sequence omitted]

SEQ ID NO: 48995 - protein, 1479 aa, Homo sapiens
  Payload ID: 9819
  Gene Symbol: MRC2
  Gene Name: mannose receptor, C type 2
  Uniprot ID: Q9UBG0
  ENSP ID: ENSP00000307513
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHFVANMLNKIFGESEPEIHEQHWFWIGLNRRDPRGGQSWRWSDGVGFSYHNFDRSRHDDDDIRGCAVLDLASLQWVAMQCDTQLDWICKIPRGTDVREPDDSPQGRREWLRFQEAEYKFFEHHSTWAQAQRICTWFQAELTSVHSQAELDFLSHNLQKFSRAQEQHWWIGLHTSESDGRFRWTDGSIINFISWAPGKPRPVGKDKKCVYMTASREDWGDQRCLTALPYICKRSNVTKETQPPDLPTTALGGCPSDWIQFLNKCFQVQGQEPQSRVKWSEAQFSCEQQEAQLVTITNPLEQAFITASLPNVTFDLWIGLHASQRDFQWVEQEPLMYANWAPGEPSGPSPAPSGNKPTSCAVVLHSPSAHFTGRWDDRSCTEETHGFICQKGTDPSLSPSPAALPPAPGTELSYLNGTFRLLQKPLRWHDALLLCESRNASLAYVPDPYTQAFLTQAARGLRTPLWIGLAGEEGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNITMGVVCKLPRAEQSSFSPSALPENPAALVVVLMAVLLLLALLTAALILYRRRQSIERGAFEGARYSRSSSSPTEATEKNILVSDMEMNEQQE

SEQ ID NO: 48996 - protein, 345 aa, Homo sapiens
  Payload ID: 9819
  Gene Symbol: MRC2
  Gene Name: mannose receptor, C type 2
  ENSP ID: ENSP00000400445
MPTGHLGSPLALALLPVATNRPAVQWSCTAPQPTSLAAGTIGAARRRPMASSARRARGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNITMGVVCKLPRAEQSSFSPSALPENPAALVVVLMAVLLLLALLTAALILYRRRQSIERGAFEGARYSRSSSSPTEATEKNILVSDMEMNEQQE

SEQ ID NO: 48997 - protein, 157 aa, Homo sapiens
  Payload ID: 9819
  Gene Symbol: MRC2
  Gene Name: mannose receptor, C type 2
  ENSP ID: ENSP00000461968
  MOD_RES (1)..(1): Any amino acid
XFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHF

SEQ ID NO: 48998 - protein, 35 aa, Homo sapiens
  Payload ID: 9819
  Gene Symbol: MRC2
  Gene Name: mannose receptor, C type 2
  ENSP ID: ENSP00000463968
MTASREDWGDQRCLTALPYICKRSNVTKETQPPDL

SEQ ID NO: 48999 - protein, 277 aa, Homo sapiens
  Payload ID: 9820
  Gene Symbol: M6PR
  Gene Name: mannose-6-phosphate receptor (cation dependent)
  Uniprot ID: P20645
  ENSP ID: ENSP00000000412
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 49000 - protein, 148 aa, Homo sapiens
  Payload ID: 9820
  Gene Symbol: M6PR
  Gene Name: mannose-6-phosphate receptor (cation dependent)
  ENSP ID: ENSP00000437595
LLLLLAVAVRESWQTEEKTCDLDNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 49001 - protein, 96 aa, Homo sapiens
  Payload ID: 9820
  Gene Symbol: M6PR
  Gene Name: mannose-6-phosphate receptor (cation dependent)
  ENSP ID: ENSP00000439070
  MOD_RES (1)..(1): Any amino acid
XILLVTFASLVAVYVVGGFLYQRLVVGAKGMEQFPHLAFWQDLGNLVAKGNGSRSGTSRALLSSALGVECCCTCPFCWLREVSSCPHFCGERFLIL

SEQ ID NO: 49002 - protein, 25 aa, Homo sapiens
  Payload ID: 9820
  Gene Symbol: M6PR
  Gene Name: mannose-6-phosphate receptor (cation dependent)
  ENSP ID: ENSP00000439968
MLIYKGGDEYDNHCGKEQRRAVVMI

SEQ ID NO: 49003 - protein, 191 aa, Homo sapiens
  Payload ID: 9820
  Gene Symbol: M6PR
  Gene Name: mannose-6-phosphate receptor (cation dependent)
  ENSP ID: ENSP00000440488
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADGCDFVCRSKPRNVPAAYRGVGDDQLGEESEERDDHLLPM

SEQ ID NO: 49004 - protein, 109 aa, Homo sapiens
  Payload ID: 9820
  Gene Symbol: M6PR
  Gene Name: mannose-6-phosphate receptor (cation dependent)
  ENSP ID: ENSP00000440962
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNET

SEQ ID NO: 49005 - protein, 92 aa, Homo sapiens
  Payload ID: 9820
  Gene Symbol: M6PR
  Gene Name: mannose-6-phosphate receptor (cation dependent)
  ENSP ID: ENSP00000441030
MFPFYSCWRTGLLLLLLAVAVRESWQTEEKTCDLVGEKGKESEKELALVKRLKPLFNKSFESTVGQGSDTYIYIFRVCREAGNHTSGAGLVQ

SEQ ID NO: 49006 - protein, 85 aa, Homo sapiens
  Payload ID: 9820
  Gene Symbol: M6PR
  Gene Name: mannose-6-phosphate receptor (cation dependent)
  ENSP ID: ENSP00000441040
VVGGFLYQRLVVGAKGMEQFPHLAFWQDLGNLVAACGFDLFFNLLERERKQKWDIEGSAVLCAGCGMLLHLSLLLAQGSVFLPTF

SEQ ID NO: 49007 - protein, 133 aa, Homo sapiens
  Payload ID: 9820
  Gene Symbol: M6PR
  Gene Name: mannose-6-phosphate receptor (cation dependent)
  ENSP ID: ENSP00000442100
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSLHHWLLFMLLGGSYTSDW

SEQ ID NO: 49008 - protein, 104 aa, Homo sapiens
  Payload ID: 9820
  Gene Symbol: M6PR
  Gene Name: mannose-6-phosphate receptor (cation dependent)
  ENSP ID: ENSP00000442983
  MOD_RES (1)..(1): Any amino acid
XFNKSFESTVGQGSDTYIYIFRVCREAGNHTSGAGLVQINKSNGKETVVGRLNETHIFNGSNWIMLIYKGGDEYDNHCGKEQRRAVVMISCNRHTLAESKHLTT

SEQ ID NO: 49009 - protein, 122 aa, Homo sapiens
  Payload ID: 9820
  Gene Symbol: M6PR
  Gene Name: mannose-6-phosphate receptor (cation dependent)
  ENSP ID: ENSP00000444684
  MOD_RES (1)..(1): Any amino acid
XGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVAVSNRAAG

SEQ ID NO: 49010 - protein, 248 aa, Homo sapiens
  Payload ID: 9821
  Gene Symbol: MBL2
  Gene Name: mannose-binding lectin (protein C) 2, soluble
  Uniprot ID: P11226
  ENSP ID: ENSP00000363079
MSLFPSLPLLLLSMVAASYSETVTCEDAQKTCPAVIACSSPGINGFPGKDGRDGTKGEKGEPGQGLRGLQGPPGKLGPPGNPGPSGSPGPKGQKGDPGKSPDGDSSLAASERKALQTEMARIKKWLTFSLGKQVGNKFFLTNGEIMTFEKVKALCVKFQASVATPRNAAENGAIQNLIKEEAFLGITDEKTEGQFVDLTGNRLTYTNWNEGEPNNAGSDEDCVLLLKNGQWNDVPCSTSHLAVCEFPI

SEQ ID NO: 49011 - protein, 247 aa, Homo sapiens
  Payload ID: 9822
  Gene Symbol: MPDU1
  Gene Name: mannose-P-dolichol utilization defect 1
  Uniprot ID: O75352
  ENSP ID: ENSP00000250124
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVTLLQASNVPAVVVGRLLQAATNYHNGHTGQLSAITVFLLFGGSLARIFTSIQETGDPLMAGTFVVSSLCNGLIAAQLLFYWNAKPPHKQKKAQ

SEQ ID NO: 49012 - protein, 61 aa, Homo sapiens
  Payload ID: 9822
  Gene Symbol: MPDU1
  Gene Name: mannose-P-dolichol utilization defect 1
  ENSP ID: ENSP00000352876
MAAEADGPLKRLLVPILLPEKCYDQLFVQWDLLHVPCLKILLSKGLGLGIVAGSLLAAPGV

SEQ ID NO: 49013 - protein, 192 aa, Homo sapiens
  Payload ID: 9822
  Gene Symbol: MPDU1
  Gene Name: mannose-P-dolichol utilization defect 1
  ENSP ID: ENSP00000379758
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGAGDLPKSRLCGSWEPCWELSFSRQPPTTTTGTQASSQPSQSSCCLGAPWPESSLPFRKPEIP

SEQ ID NO: 49014 - protein, 186 aa, Homo sapiens
  Payload ID: 9822
  Gene Symbol: MPDU1
  Gene Name: mannose-P-dolichol utilization defect 1
  Uniprot ID: O75352
  ENSP ID: ENSP00000414071
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFRCRFPRLLRPGPAGASLTSDALDCSHPAPGLQCACCGGGEASPGSHQLPQRAHRPALSHHSLPAVWGLPGPNLHFHSGVSIPFSQL

SEQ ID NO: 49015 - protein, 61 aa, Homo sapiens; identical to SEQ ID NO: 49012
  Payload ID: 9822
  Gene Symbol: MPDU1
  Gene Name: mannose-P-dolichol utilization defect 1
  ENSP ID: ENSP00000458741

SEQ ID NO: 49016 - protein, 61 aa, Homo sapiens; identical to SEQ ID NO: 49012
  Payload ID: 9822
  Gene Symbol: MPDU1
  Gene Name: mannose-P-dolichol utilization defect 1
  ENSP ID: ENSP00000459306

SEQ ID NO: 49017 - protein, 61 aa, Homo sapiens
  Payload ID: 9822
  Gene Symbol: MPDU1
  Gene Name: mannose-P-dolichol utilization defect 1
  ENSP ID: ENSP00000459409
  MOD_RES (1)..(1): Any amino acid
XADGPLKRLLVPILLPEKCYDQLFVQWDLLHVPCLKILLSKGLGLGIVAGSLLALGVKPYS

SEQ ID NO: 49018 - protein, 109 aa, Homo sapiens
  Payload ID: 9822
  Gene Symbol: MPDU1
  Gene Name: mannose-P-dolichol utilization defect 1
  ENSP ID: ENSP00000459498
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFRPAFLPPNS

SEQ ID NO: 49019 - protein, 54 aa, Homo sapiens
  Payload ID: 9822
  Gene Symbol: MPDU1
  Gene Name: mannose-P-dolichol utilization defect 1
  ENSP ID: ENSP00000460864
  MOD_RES (1)..(1): Any amino acid
XLKRLLVPILLPEKCYDQLFVQWDLLHVPCLKILLSKGLGLGIVAGSLLAAPGV

SEQ ID NO: 49020 - protein, 75 aa, Homo sapiens
  Payload ID: 9822
  Gene Symbol: MPDU1
  Gene Name: mannose-P-dolichol utilization defect 1
  ENSP ID: ENSP00000461183
MAAEADGPLKRLLVPILLPEKCYDQLFVQWDLLHDISCLLTLFSLLSPLPQDSPQQRPGAGHCGWLTSSKAAPGV

SEQ ID NO: 49021 - protein, 32 aa, Homo sapiens
  Payload ID: 9822
  Gene Symbol: MPDU1
  Gene Name: mannose-P-dolichol utilization defect 1
  ENSP ID: ENSP00000461499
  MOD_RES (1)..(1): Any amino acid
XLLVPILLPEKCYDQLFVQWDLLHALGVKPYS

SEQ ID NO: 49022 - protein, 109 aa, Homo sapiens; identical to SEQ ID NO: 49018
  Payload ID: 9822
  Gene Symbol: MPDU1
  Gene Name: mannose-P-dolichol utilization defect 1
  ENSP ID: ENSP00000462229

SEQ ID NO: 49023 - protein, 52 aa, Homo sapiens
  Payload ID: 9822
  Gene Symbol: MPDU1
  Gene Name: mannose-P-dolichol utilization defect 1
  ENSP ID: ENSP00000462500
MAAEADGPLKRLLVPILLPEKCYDQLFVQWDLLHGEFYSASDPSPTRVTVGP

SEQ ID NO: 49024 - protein, 154 aa, Homo sapiens
  Payload ID: 9822
  Gene Symbol: MPDU1
  Gene Name: mannose-P-dolichol utilization defect 1
  ENSP ID: ENSP00000462839
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSFSRQPPTTTTGTQASSQPSQSSCCLGAPWPESSLPFRGEHPILSALRKDSGVQ

SEQ ID NO: 49025 - protein, 116 aa, Homo sapiens
  Payload ID: 9822
  Gene Symbol: MPDU1
  Gene Name: mannose-P-dolichol utilization defect 1
  ENSP ID: ENSP00000463037
ADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLV

SEQ ID NO: 49026 - protein, 109 aa, Homo sapiens; identical to SEQ ID NO: 49018
  Payload ID: 9822
  Gene Symbol: MPDU1
  Gene Name: mannose-P-dolichol utilization defect 1
  ENSP ID: ENSP00000463056

SEQ ID NO: 49027 - protein, 152 aa, Homo sapiens
  Payload ID: 9822
  Gene Symbol: MPDU1
  Gene Name: mannose-P-dolichol utilization defect 1
  ENSP ID: ENSP00000463966
RLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKASPGSHQLPQRAHRPALSHHSLPAVWGLPGPNL

SEQ ID NO: 49028 - protein, 193 aa, Homo sapiens
  Payload ID: 9822
  Gene Symbol: MPDU1
  Gene Name: mannose-P-dolichol utilization defect 1
  ENSP ID: ENSP00000464158
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVTLLQASNVPAVVVGRAATNYHNGHTGQLSAITVFLLFGG

SEQ ID NO: 49029 - protein, 101 aa, Homo sapiens
  Payload ID: 9822
  Gene Symbol: MPDU1
  Gene Name: mannose-P-dolichol utilization defect 1
  ENSP ID: ENSP00000464524
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFR

SEQ ID NO: 49030 - protein, 299 aa, Homo sapiens
  Payload ID: 9822
  Gene Symbol: MPDU1
  Gene Name: mannose-P-dolichol utilization defect 1
  ENSP ID: ENSP00000479257
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVPAPGLQCACCGGGEASPGSHQLPQRAHRPALSHHSLPAVWGLPGPNLHFHSGNRRSPDGWDLCGLLSLQRPHRRPAALLLECKASPQAEKGAVEPATGVIPFPLIHPTSGFSPSEPACWCDLLILHSSALADFLSQGFLLVETNG

SEQ ID NO: 49031 - protein, 211 aa, Homo sapiens
  Payload ID: 9822
  Gene Symbol: MPDU1
  Gene Name: mannose-P-dolichol utilization defect 1
  ENSP ID: ENSP00000483915
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVTLLQASNVPAVVVGRLLQAATNTTTGTQASSQPSQSSCCLGAPWPESSLPFRKPEIP

SEQ ID NO: 49032 - protein, 299 aa, Homo sapiens [sequence omitted]

SEQ ID NO: 49033 - protein, 653 aa, Homo sapiens
  Payload ID: 9823
  Gene Symbol: MAN1A1
  Gene Name: mannosidase, alpha, class 1A, member 1
  Uniprot ID: P33908
  ENSP ID: ENSP00000357453
MPVGGLLPLFSSPAGGVLGGGLGGGGGRKGSGPAALRLTEKFVLLLVFSAFITLCFGAIFFLPDSSKLLSGVLFHSSPALQPAADHKPGPGARAEDAAEGRARRREEGAPGDPEAALEDNLARIRENHERALREAKETLQKLPEEIQRDILLEKKKVAQDQLRDKAPFRGLPPVDFVPPIGVESREPADAAIREKRAKIKEMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKSGIGRNWPWASGGSSILAEFGTLHLEFMHLSHLSGNPIFAEKVMNIRTVLNKLEKPQGLYPNYLNPSSGQWGQHHVSVGGLGDSFYEYLLKAWLMSDKTDLEAKKMYFDAVQAIETHLIRKSSSGLTYIAEWKGGLLEHKMGHLTCFAGGMFALGADAAPEGMAQHYLELGAEIARTCHESYNRTFMKLGPEAFRFDGGVEAIATRQNEKYYILRPEVMETYMYMWRLTHDPKYRKWAWEAVEALENHCRVNGGYSGLRDVYLLHESYDDVQQSFFLAETLKYLYLIFSDDDLLPLEHWIFNSEAHLLPILPKDKKEVEIREE

SEQ ID NO: 49034 - protein, 641 aa, Homo sapiens
  Payload ID: 9824
  Gene Symbol: MAN1A2
  Gene Name: mannosidase, alpha, class 1A, member 2
  Uniprot ID: O60476
  ENSP ID: ENSP00000348959
MTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVVQEMKIKENKPLPPVPIPNLVGIRGGDPEDNDIREKREKIKEMMKHAWDNYRTYGWGHNELRPIARKGHSPNIFGSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKYLYLLFSGDDLLPLDHWVFNTEAHPLPVLHLANTTLSGNPAVR

SEQ ID NO: 49035 - protein, 204 aa, Homo sapiens
  Payload ID: 9824
  Gene Symbol: MAN1A2
  Gene Name: mannosidase, alpha, class 1A, member 2
  ENSP ID: ENSP00000396362
  MOD_RES (1)..(1): Any amino acid
XIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKYLYLLFSGDDLLPLDHWVFNTEAHPLPVLHLANTTLSES

SEQ ID NO: 49036 - protein, 97 aa, Homo sapiens
  Payload ID: 9824
  Gene Symbol: MAN1A2
  Gene Name: mannosidase, alpha, class 1A, member 2
  ENSP ID: ENSP00000402416
EKYCRVNGGFSGVKDVYSSTPTHDDVQQSFFLAETLKYLYLLFSGDDLLPLDHWVFNTEAHPLPVLHLANTTLSGTSQGMRRQNPYFQVLYLYYPDD

SEQ ID NO: 49037 - protein, 331 aa, Homo sapiens
  Payload ID: 9824
  Gene Symbol: MAN1A2
  Gene Name: mannosidase, alpha, class 1A, member 2
  ENSP ID: ENSP00000412706
  MOD_RES (1)..(1): Any amino acid
XIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLN

SEQ ID NO: 49038 - protein, 699 aa, Homo sapiens
  Payload ID: 9825
  Gene Symbol: MAN1B1
  Gene Name: mannosidase, alpha, class 1B, member 1
  Uniprot ID: Q9UKM7
  ENSP ID: ENSP00000360645
MAACEGRRSGALGSSQSDFLTPPVGGAPWAVATTVVMYPPPPPPPHRDFISVTLSFGENYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAHPLPIWTPA

SEQ ID NO: 49039 - protein, 52 aa, Homo sapiens
  Payload ID: 9825
  Gene Symbol: MAN1B1
  Gene Name: mannosidase, alpha, class 1B, member 1
  ENSP ID: ENSP00000440314
PWAVATTVVMYPPPPPPPHRDFISVTLSFGENYDNSKSWRRRSCWRVRVAPG

SEQ ID NO: 49040 - protein, 695 aa, Homo sapiens
  Payload ID: 9825
  Gene Symbol: MAN1B1
  Gene Name: mannosidase, alpha, class 1B, member 1
  ENSP ID: ENSP00000441398
MYPPPPPPPHRDFISVTLSFGENYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVSTCPRPAWSRPPGHRHGWAVGLRLAPLLVVAVTWIREGRACRSLGVATLQLGGPGIPIPTELHGCGTQSTWRGWAPLIFISQGLSREGLCCGPSIPPV

SEQ ID NO: 49041 - protein, 182 aa, Homo sapiens
  Payload ID: 9825
  Gene Symbol: MAN1B1
  Gene Name: mannosidase, alpha, class 1B, member 1
  ENSP ID: ENSP00000444189
  MOD_RES (1)..(1): Any amino acid
XWAVATTVVMYPPPPPPPHRDFISVTLSFGENYDNSKSWRRRSCWRKWKQLSRLQRNMILFLLAFLLFCGLLFYINLADHWKAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPA

SEQ ID NO: 49042 - protein, 550 aa, Homo sapiens
  Payload ID: 9825
  Gene Symbol: MAN1B1
  Gene Name: mannosidase, alpha, class 1B, member 1
  ENSP ID: ENSP00000444966
MAACEGRRSGALGSSQSDFLTPPVGGAPWAVATTVVMYPPPPPPPHRDFISVTLSFGENYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMGRWLWASTTACPPATWSWPRSSWRLVTR

SEQ ID NO: 49043 - protein, 270 aa, Homo sapiens
  Payload ID: 9825
  Gene Symbol: MAN1B1
  Gene Name: mannosidase, alpha, class 1B, member 1
  ENSP ID: ENSP00000448658
  MOD_RES (1)..(1): Any amino acid
XFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRPGCLRVQHRSPPSAYLDPCLGWMAAGVGTSGGQRHLAGSVAFSKGPRSTGNRQVAQALNWLWAPPRLCFNQDTVRTSEAVSLGVMRGGLGRWSLRLLPPEDTNHDSRLLKPEQVSVGRPEGGFEVVPGTGVTEWTAQGAALPGLVKPQMSPIQGSGGAAVTPEA

SEQ ID NO: 49044 - protein, 124 aa, Homo sapiens
  Payload ID: 9825
  Gene Symbol: MAN1B1
  Gene Name: mannosidase, alpha, class 1B, member 1
  ENSP ID: ENSP00000450147
  MOD_RES (1)..(1): Any amino acid
XETGLSPEIVHFNLYPQPGRRDVEVKPADRHNLLRPETVESLFYLYRVTGDRKYQDWGWEILQSFSRFTRDPQKPEPRDKMESFFLGETLKYLFLLFSDDPNLLSLDAYVFNTEAHPLPIWTPA

SEQ ID NO: 49045 - protein, 115 aa, Homo sapiens
  Payload ID: 9825
  Gene Symbol: MAN1B1
  Gene Name: mannosidase, alpha, class 1B, member 1
  ENSP ID: ENSP00000483132
PWAVATTVVMYPPPPPPPHRDFISVTLSFGENYDNSKSWRRRSCWRKWKQLSRLQRNMILFLLAFLLFCGLLFYINLADHWKAPGGIYGNELARNQDKEKGRAVCNHLARTQMLI

SEQ ID NO: 49046 - protein, 450 aa, Homo sapiens
  Payload ID: 9826
  Gene Symbol: MAN1C1
  Gene Name: mannosidase, alpha, class 1C, member 1
  ENSP ID: ENSP00000263979
MMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 49047 - protein, 401 aa, Homo sapiens
  Payload ID: 9826
  Gene Symbol: MAN1C1
  Gene Name: mannosidase, alpha, class 1C, member 1
  ENSP ID: ENSP00000363449
MELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 49048 - protein, 630 aa, Homo sapiens
  Payload ID: 9826
  Gene Symbol: MAN1C1
  Gene Name: mannosidase, alpha, class 1C, member 1
  Uniprot ID: Q9NR34
  ENSP ID: ENSP00000363452
MLMRKVPGFVPASPWGLRLPQKFLFLLFLSGLVTLCFGALFLLPHSSRLKRLFLAPRTQQPGLEVVAEIAGHAPAREQEPPPNPAPAAPAPGEDDPSSWASPRRRKGGLRRTRPTGPREEATAARGNSIPASRPGDEGVPFRFDFNAFRSRLRHPVLGTRADESQEPQSQVRAQREKIKEMMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 49049 - protein, 362 aa, Homo sapiens [sequence omitted]

SEQ ID NO: 49050 - protein, 1144 aa, Homo sapiens
  Payload ID: 9827
  Gene Symbol: MAN2A1
  Gene Name: mannosidase, alpha, class 2A, member 1
  Uniprot ID: Q16706
  ENSP ID: ENSP00000261483
MKLSRQFTVFGSAIFCVVIFSLYLMLDRGHLDYPRNPRREGSFPQGQLSMLQEKIDHLERLLAENNEIISNIRDSVINLSESVEDGPKSSQSNFSQGAGSHLLPSQLSLSVDTADCLFASQSGSHNSDVQMLDVYSLISFDNPDGGVWKQGFDITYESNEWDTEPLQVFVVPHSHNDPGWLKTFNDYFRDKTQYIFNNMVLKLKEDSRRKFIWSEISYLSKWWDIIDIQKKDAVKSLIENGQLEIVTGGWVMPDEATPHYFALIDQLIEGHQWLENNIGVKPRSGWAIDPFGHSPTMAYLLNRAGLSHMLIQRVHYAVKKHFALHKTLEFFWRQNWDLGSVTDILCHMMPFYSYDIPHTCGPDPKICCQFDFKRLPGGRFGCPWGVPPETIHPGNVQSRARMLLDQYRKKSKLFRTKVLLAPLGDDFRYCEYTEWDLQFKNYQQLFDYMNSQSKFKVKIQFGTLSDFFDALDKADETQRDKGQSMFPVLSGDFFTYADRDDHYWSGYFTSRPFYKRMDRIMESHLRAAEILYYFALRQAHKYKINKFLSSSLYTALTEARRNLGLFQHHDAITGTAKDWVVVDYGTRLFHSLMVLEKIIGNSAFLLILKDKLTYDSYSPDTFLEMDLKQKSQDSLPQKNIIRLSAEPRYLVVYNPLEQDRISLVSVYVSSPTVQVFSASGKPVEVQVSAVWDTANTISETAYEISFRAHIPPLGLKVYKILESASSNSHLADYVLYKNKVEDSGIFTIKNMINTEEGITLENSFVLLRFDQTGLMKQMMTKEDGKHHEVNVQFSWYGTTIKRDKSGAYLFLPDGNAKPYVYTTPPFVRVTHGRIYSEVTCFFDHVTHRVRLYHIQGIEGQSVEVSNIVDIRKVYNREIAMKISSDIKSQNRFYTDLNGYQIQPRMTLSKLPLQANVYPMTTMAYIQDAKHRLTLLSAQSLGVSSLNSGQIEVIMDRRLMQDDNRGLEQGIQDNKITANLFRILLEKRSAVNTEEEKKSVSYPSLLSHITSSLMNHPVIPMANKFSSPTLELQGEFSPLQSSLPCDIHLVNLRTIQSKVGNGHSNEAALILHRKGFDCRFSSKGTGLFCSTTQGKILVQKLLNKFIVESLTPSSLSLMHSPPGTQNISEINLSPMEISTFRIQLR

SEQ ID NO: 49051 - protein, 1150 aa, Homo sapiens
  Payload ID: 9828
  Gene Symbol: MAN2A2
  Gene Name: mannosidase, alpha, class 2A, member 2
  Uniprot ID: P49641
  ENSP ID: ENSP00000353655
MKLKKQVTVCGAAIFCVAVFSLYLMLDRVQHDPTRHQNGGNFPRSQISVLQNRIEQLEQLLEENHEIISHIKDSVLELTANAEGPPAMLPYYTVNGSWVVPPEPRPSFFSISPQDCQFALGGRGQKPELQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERAALLLDQYRKKSQLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 49052 - protein, 796 aa, Homo sapiens
  Payload ID: 9828
  Gene Symbol: MAN2A2
  Gene Name: mannosidase, alpha, class 2A, member 2
  ENSP ID: ENSP00000452631
MKLKKQVTVCGAAIFCVAVFSLYLMLDRVQHDPTRHQNGGNFPRSQISVLQNRIEQLEQLLEENHEIISHIKDSVLELTANAEGPPAMLPYYTVNGSWVVPPEPRPSFFSISPQDCQFALGGRGQKPELQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERAALLLDQYRKKSQLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKGSGLCFLAEHPKGG

SEQ ID NO: 49053 - protein, 50 aa, Homo sapiens
  Payload ID: 9828
  Gene Symbol: MAN2A2
  Gene Name: mannosidase, alpha, class 2A, member 2
  ENSP ID: ENSP00000452691
MKLKKQVTVCGAAIFCVAVFSLYLMLDRVQHDPTRHQNGGNFPRSQISVL

SEQ ID NO: 49054 - protein, 360 aa, Homo sapiens
  Payload ID: 9828
  Gene Symbol: MAN2A2
  Gene Name: mannosidase, alpha, class 2A, member 2
  ENSP ID: ENSP00000452813
  MOD_RES (1)..(1): Any amino acid
XFPLRVIDSGTSDFALSNRYMQVWFSGLTGLLKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 49055 - protein, 329 aa, Homo sapiens
  Payload ID: 9828
  Gene Symbol: MAN2A2
  Gene Name: mannosidase, alpha, class 2A, member 2
  ENSP ID: ENSP00000452866
  MOD_RES (1)..(1): Any amino acid
XPRSAANLISNACLVGASTALGRCHPGPSQRPTWQRGQPCFWTNTGRSPSCSEATSSWCLLEMTSDMTSPRSGMPSSSTTNGSLTSSTAGLTSMCRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSG

SEQ ID NO: 49056 - protein, 195 aa, Homo sapiens
  Payload ID: 9828
  Gene Symbol: MAN2A2
  Gene Name: mannosidase, alpha, class 2A, member 2
  ENSP ID: ENSP00000452897
  MOD_RES (1)..(1): Any amino acid
XMLPYYTVNGSWVVPPEPRPSFFSISPQDCQFALGGRGQKPELQMLTVSEELPFDNVDGGVWRQGFDISYDPHDWDAEDLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAI

SEQ ID NO: 49057 - protein, 264 aa, Homo sapiens
  Payload ID: 9828
  Gene Symbol: MAN2A2
  Gene Name: mannosidase, alpha, class 2A, member 2
  ENSP ID: ENSP00000452928
  MOD_RES (1)..(1): Any amino acid
XARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPSPPSTHRFVVLFNPLEQERFSMVSLLVNSPRVRVLSEEGQPLAVQISAHWSSATEAVPDVYQVSVPVRLPALGLGVLQLQLGLDGHRTLPSSVRIY

SEQ ID NO: 49058 - protein, 1150 aa, Homo sapiens; identical to SEQ ID NO: 49051
  Payload ID: 9828
  Gene Symbol: MAN2A2
  Gene Name: mannosidase, alpha, class 2A, member 2
  Uniprot ID: P49641
  ENSP ID: ENSP00000452948

SEQ ID NO: 49059 - protein, 120 aa, Homo sapiens
  Payload ID: 9828
  Gene Symbol: MAN2A2
  Gene Name: mannosidase, alpha, class 2A, member 2
  ENSP ID: ENSP00000453078
MKLKKQVTVCGAAIFCVAVFSLYLMLDRVQHDPTRHQNGGNFPRSQISVLQNRIEQLEQLLEENHEIISHIKDSVLELTANAEGPPAMLPYYTVNGSWVVPPEPRPSFFSISPQDCQFAL

SEQ ID NO: 49060 - protein, 793 aa, Homo sapiens
  Payload ID: 9828
  Gene Symbol: MAN2A2
  Gene Name: mannosidase, alpha, class 2A, member 2
  ENSP ID: ENSP00000453140
YAIKKHFAATHSLEFMWRQTWDSDSSTDIFCHMMPFYSYDVPHTCGPDPKICCQFDFKRLPGGRINCPWKVPPRAITEANVAERAALLLDQYRKKSQLFRSNVLLVPLGDDFRYDKPQEWDAQFFNYQRLFDFFNSRPNLHVQDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 49061 - protein, 164 aa, Homo sapiens
  Payload ID: 9828
  Gene Symbol: MAN2A2
  Gene Name: mannosidase, alpha, class 2A, member 2
  ENSP ID: ENSP00000453253
  MOD_RES (1)..(1): Any amino acid
XTSPRSPPCCVSLKALSSQRWLRTMSTFTRRSGFTICQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQ

SEQ ID NO: 49062 - protein, 319 aa, Homo sapiens
  Payload ID: 9828
  Gene Symbol: MAN2A2
  Gene Name: mannosidase, alpha, class 2A, member 2
  ENSP ID: ENSP00000453341
  MOD_RES (1)..(1): Any amino acid
XKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEPDFFSKLAAMFRGLIFHSSRSGNREVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSL

SEQ ID NO: 49063 - protein, 58 aa, Homo sapiens
  Payload ID: 9828
  Gene Symbol: MAN2A2
  Gene Name: mannosidase, alpha, class 2A, member 2
  ENSP ID: ENSP00000453659
  MOD_RES (1)..(1): Any amino acid
XCTTSQGKVALGSLFHGLDVVFLQPTSLTLLYPLASPSNSTDVYLEPMEIATFRLRLG

SEQ ID NO: 49064 - protein, 72 aa, Homo sapiens
  Payload ID: 9828
  Gene Symbol: MAN2A2
  Gene Name: mannosidase, alpha, class 2A, member 2
  ENSP ID: ENSP00000453740
MKLKKQVTVCGAAIFCVAVFSLYLMLDRVQHDPTRHQNGGNFPRSQISVLQNRIEQLEQLLEENHEIISHIK

SEQ ID NO: 49065 - protein, 76 aa, Homo sapiens
  Payload ID: 9828
  Gene Symbol: MAN2A2
  Gene Name: mannosidase, alpha, class 2A, member 2
  ENSP ID: ENSP00000453956
MKLKKQVTVCGAAIFCVAVFSLYLMLDRVQHDPTRHQNGGNFPRSQISVLQNRIEQLEQLLEENHEIISHIKDSVL

SEQ ID NO: 49066 - protein, 938 aa, Homo sapiens
  Payload ID: 9828
  Gene Symbol: MAN2A2
  Gene Name: mannosidase, alpha, class 2A, member 2
  ENSP ID: ENSP00000453999
MKLKKQVTVCGAAIFCVAVFSLYLMLDRVQHDPTRHQNGGNFPRSQISVLQNRIEQLEQLLEENHEIISHIKDSVLELTANAEGPPAMLPYYTVNGSWVVPPEPRPSFFSISPQDCQFALGGRGQKPELQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERAALLLDQYRKKSQLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKELALHIHTDIDSQGAAPTVSEEAPPPGQLLPHASHGLYPGRTEAPHAAHCPGPGCL

SEQ ID NO: 49067 - protein, 1010 aa, Homo sapiens
  Payload ID: 9829
  Gene Symbol: MAN2B1
  Gene Name: mannosidase, alpha, class 2B, member 1
  Uniprot ID: O00754
  ENSP ID: ENSP00000221363
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 49068 - protein, 1011 aa, Homo sapiens
  Payload ID: 9829
  Gene Symbol: MAN2B1
  Gene Name: mannosidase, alpha, class 2B, member 1
  Uniprot ID: O00754
  ENSP ID: ENSP00000395473
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 49069 - protein, 67 aa, Homo sapiens
  Payload ID: 9829
  Gene Symbol: MAN2B1
  Gene Name: mannosidase, alpha, class 2B, member 1
  ENSP ID: ENSP00000469456
  MOD_RES (1)..(1): Any amino acid
XSDVVIFPSSDSQAHPPELLFSASLPALGFSTYSVAQVPRWKPQARAPQPIPRRSWSPALTIENEGC

SEQ ID NO: 49070 - protein, 164 aa, Homo sapiens
  Payload ID: 9829
  Gene Symbol: MAN2B1
  Gene Name: mannosidase, alpha, class 2B, member 1
  ENSP ID: ENSP00000470174
MGAYARASGVCARGCLDSAGPWTMSRALRPPLPPLCFFLLLLAAAGARAGGYESRMTSSTPVCSTSWTRSSLPCWQIPPVASFTWRLPSSPVGGTSRQMPHRKSCETLCARMGFDGFFFGRLDYQDKWVRMQKLEMEQVWRASTSLKPPTADLFTGVLPNGYNP

SEQ ID NO: 49071 - protein, 172 aa, Homo sapiens
  Payload ID: 9829
  Gene Symbol: MAN2B1
  Gene Name: mannosidase, alpha, class 2B, member 1
  ENSP ID: ENSP00000470533
MGAYARASGVCARGCLDSAGPWTMSRALRPPLPPLCFFLLLLAAAGARAGGYEVCVFGVPVQTCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAAT

SEQ ID NO: 49072 - protein, 140 aa, Homo sapiens
  Payload ID: 9829
  Gene Symbol: MAN2B1
  Gene Name: mannosidase, alpha, class 2B, member 1
  ENSP ID: ENSP00000471685
  MOD_RES (1)..(1): Any amino acid
XLAAGWGPCEVLLSNALARLRGFKDHFTFCQQLNISICPLSQTAARFQVIVYNPLGRKVNWMVRLPVSEGVFVVKDPNGRTVPSDLRQPGAPSGAAVLSLTARPGLQHLFSSPGASLEAPGPRTTAHPQKILVPCFNHRK

SEQ ID NO: 49073 - protein, 1009 aa, Homo sapiens
  Payload ID: 9830
  Gene Symbol: MAN2B2
  Gene Name: mannosidase, alpha, class 2B, member 2
  Uniprot ID: Q9Y2E5
  ENSP ID: ENSP00000285599
MGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPQDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEAVLQALGSVVAVEERSLTGTWDLSMLHRWSWRTGPGRHRGDTTSPSRPPGGPIITVHPKEIRTFFIHFQQQ

SEQ ID NO: 49074 - protein, 958 aa, Homo sapiens
  Payload ID: 9830
  Gene Symbol: MAN2B2
  Gene Name: mannosidase, alpha, class 2B, member 2
  ENSP ID: ENSP00000423129
MGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPQDGVYPNMSEPVTPANINLYAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEAVLQALGSVVAVEERSLTGTWDLSMLHRWSWRTGPGRHRGDTTSPSRPPGGPIITVHPKEIRTFFIHFQQQ

SEQ ID NO: 49075 - protein, 953 aa, Homo sapiens
  Payload ID: 9830
  Gene Symbol: MAN2B2
  Gene Name: mannosidase, alpha, class 2B, member 2
  ENSP ID: ENSP00000426273
  MOD_RES (1)..(1): Any amino acid
XQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPQDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEVNFPTPIQTISQGSKP

SEQ ID NO: 49076 - protein, 1040 aa, Homo sapiens
  Payload ID: 9831
  Gene Symbol: MAN2C1
  Gene Name: mannosidase, alpha, class 2C, member 1
  Uniprot ID: Q9NTJ4
  ENSP ID: ENSP00000267978
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 49077 - protein, 209 aa, Homo sapiens
  Payload ID: 9831
  Gene Symbol: MAN2C1
  Gene Name: mannosidase, alpha, class 2C, member 1
  ENSP ID: ENSP00000390738
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKPGFGPSKRL

SEQ ID NO: 49078 - protein, 180 aa, Homo sapiens
  Payload ID: 9831
  Gene Symbol: MAN2C1
  Gene Name: mannosidase, alpha, class 2C, member 1
  ENSP ID: ENSP00000454406
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRRLECNGTISAHCDRRLPGSSNSPASASLLAEITASLSMWK

SEQ ID NO: 49079 - protein, 941 aa, Homo sapiens
  Payload ID: 9831
  Gene Symbol: MAN2C1
  Gene Name: mannosidase, alpha, class 2C, member 1
  Uniprot ID: Q9NTJ4
  ENSP ID: ENSP00000454589
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 49080 - protein, 183 aa, Homo sapiens
  Payload ID: 9831
  Gene Symbol: MAN2C1
  Gene Name: mannosidase, alpha, class 2C, member 1
  ENSP ID: ENSP00000455788
MAAAPALKHWRTTLERVEKFVSPLYFTDCNLRGSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLL

SEQ ID NO: 49081 - protein, 89 aa, Homo sapiens
  Payload ID: 9831
  Gene Symbol: MAN2C1
  Gene Name: mannosidase, alpha, class 2C, member 1
  ENSP ID: ENSP00000455803
MAAAPALKHWRTTLERVEKFVSPLYFTDCNLRGRLFGASCPVAVLSSFLTPERLPYQEAVQRDFRPAQVGDSFGPTSLADGGPAGSGWS

SEQ ID NO: 49082 - protein, 1017 aa, Homo sapiens
  Payload ID: 9831
  Gene Symbol: MAN2C1
  Gene Name: mannosidase, alpha, class 2C, member 1
  Uniprot ID: Q9NTJ4
  ENSP ID: ENSP00000455998
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 49083 - protein, 182 aa, Homo sapiens
  Payload ID: 9831
  Gene Symbol: MAN2C1
  Gene Name: mannosidase, alpha, class 2C, member 1
  ENSP ID: ENSP00000456257
MAAAPALKHWRTTLERVEKFVSPLYFTDCNLRGRWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCD

SEQ ID NO: 49084 - protein, 77 aa, Homo sapiens
  Payload ID: 9831
  Gene Symbol: MAN2C1
  Gene Name: mannosidase, alpha, class 2C, member 1
  ENSP ID: ENSP00000456419
MAAAPALKHWRTTLERVEKFVSPLYFTDCNLRGRLFGASCPVAVLSSFLTPERLPYQEAVQRDFRPAQVGDSFGPTW

SEQ ID NO: 49085 - protein, 172 aa, Homo sapiens
  Payload ID: 9831
  Gene Symbol: MAN2C1
  Gene Name: mannosidase, alpha, class 2C, member 1
  ENSP ID: ENSP00000456667
GLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAPEGIDSDAAEVLGSQNKGFLCCAKM

SEQ ID NO: 49086 - protein, 77 aa, Homo sapiens; identical to SEQ ID NO: 49084
  Payload ID: 9831
  Gene Symbol: MAN2C1
  Gene Name: mannosidase, alpha, class 2C, member 1
  ENSP ID: ENSP00000456914

SEQ ID NO: 49087 - protein, 1057 aa, Homo sapiens
  Payload ID: 9831
  Gene Symbol: MAN2C1
  Gene Name: mannosidase, alpha, class 2C, member 1
  Uniprot ID: Q9NTJ4
  ENSP ID: ENSP00000457788
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLGLTPSPGDSAQHGLCSCSSPHLTAAPAAPAACVRSARAPTDSASRPPPTKTDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 49088 - protein, 182 aa, Homo sapiens
  Payload ID: 9831
  Gene Symbol: MAN2C1
  Gene Name: mannosidase, alpha, class 2C, member 1
  ENSP ID: ENSP00000457833
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRRFKRFSCLSFPSSRDYSLTLYVEVACNGLLGAGKGSMIAAPD

SEQ ID NO: 49089 - protein, 425 aa, Homo sapiens
  Payload ID: 9831
  Gene Symbol: MAN2C1
  Gene Name: mannosidase, alpha, class 2C, member 1
  ENSP ID: ENSP00000479988
MALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTSGQPPEAHLFSLPSAVPVARASASATLSPWGWGFVCRRLWGLLISASPA

SEQ ID NO: 49090 - protein, 879 aa, Homo sapiens
  Payload ID: 9832
  Gene Symbol: MANBA
  Gene Name: mannosidase, beta A, lysosomal
  Uniprot ID: O00462
  ENSP ID: ENSP00000226578
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITAIISQQGDIFVFDLETSAVAPFVWLDVGSIPGRFSDNGFLMTEKTRTILFYPWEPTSKNELEQSFHVTSLTDIY

SEQ ID NO: 49091 - protein, 68 aa, Homo sapiens
  Payload ID: 9832
  Gene Symbol: MANBA
  Gene Name: mannosidase, beta A, lysosomal
  ENSP ID: ENSP00000422001
MRLHLLLLLALCGAGTTAAELSYSLRGNWSICNGNGSLELPGAVPGCVHSALFQQGLIQSLTLSPRLE

SEQ ID NO: 49092 - protein, 822 aa, Homo sapiens
  Payload ID: 9832
  Gene Symbol: MANBA
  Gene Name: mannosidase, beta A, lysosomal
  ENSP ID: ENSP00000427322
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITAIISQQGDIFVFDLETSAVAPFVWLDVGSIPGRFSDNGFLMTEKTRTILFYPWEPTSKNELEQSFHVTSLTDIY

SEQ ID NO: 49093 - protein, 85 aa, Homo sapiens
  Payload ID: 9833
  Gene Symbol: MANBAL
  Gene Name: mannosidase, beta A, lysosomal-like
  Uniprot ID: Q9NQG1
  ENSP ID: ENSP00000362707
MASDLDFSPPEVPEPTFLENLLRYGLFLGAIFQLICVLAIIVPIPKSHEAEAEPSEPRSAEVTRKPKAAVPSVNKRPKKETKKKR

SEQ ID NO: 49094 - protein, 85 aa, Homo sapiens; identical to SEQ ID NO: 49093
  Payload ID: 9833
  Gene Symbol: MANBAL
  Gene Name: mannosidase, beta A, lysosomal-like
  Uniprot ID: Q9NQG1
  ENSP ID: ENSP00000362708

SEQ ID NO: 49095 - protein, 56 aa, Homo sapiens
  Payload ID: 9833
  Gene Symbol: MANBAL
  Gene Name: mannosidase, beta A, lysosomal-like
  ENSP ID: ENSP00000380337
MASDLDFSPPEVPEPTFLENLLRYGLFLGAIFQLICVLAIIVPIPKSHEAEFHVEA

SEQ ID NO: 49096 - protein, 85 aa, Homo sapiens; identical to SEQ ID NO: 49093
  Payload ID: 9833
  Gene Symbol: MANBAL
  Gene Name: mannosidase, beta A, lysosomal-like
  Uniprot ID: Q9NQG1
  ENSP ID: ENSP00000380338

SEQ ID NO: 49097 - protein, 85 aa, Homo sapiens; identical to SEQ ID NO: 49093
  Payload ID: 9833
  Gene Symbol: MANBAL
  Gene Name: mannosidase, beta A, lysosomal-like
  Uniprot ID: Q9NQG1
  ENSP ID: ENSP00000380339

SEQ ID NO: 49098 - protein, 462 aa, Homo sapiens
  Payload ID: 9834
  Gene Symbol: MANEA
  Gene Name: mannosidase, endo-alpha
  Uniprot ID: Q5SRI9
  ENSP ID: ENSP00000351669
MAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDPRIAKNYPQGRHNPPDDIGSSFYPELGSYSSRDPSVIETHMRQMRSASIGVLALSWYPPDVNDENGEPTDNLVPTILDKAHKYNLKVTFHIEPYSNRDDQNMYKNVKYIIDKYGNHPAFYRYKTKTGNALPMFYVYDSYITKPEKWANLLTTSGSRSIRNSPYDGLFIALLVEEKHKYDILQSGFDGIYTYFATNGFTYGSSHQNWASLKLFCDKYNLIFIPSVGPGYIDTSIRPWNTQNTRNRINGKYYEIGLSAALQTRPSLISITSFNEWHEGTQIEKAVPKRTSNTVYLDYRPHKPGLYLELTRKWSEKYSKERATYALDRQLPVS

SEQ ID NO: 49099 - protein, 198 aa, Homo sapiens
  Payload ID: 9834
  Gene Symbol: MANEA
  Gene Name: mannosidase, endo-alpha
  ENSP ID: ENSP00000358299
MAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDPRIAKNYPQGRHNPPDDIGSSFYPELGSYSSRDPSVIETHMRQMRSASIGNYCIYIYVCLCLYICI

SEQ ID NO: 49100 - protein, 207 aa, Homo sapiens
  Payload ID: 9834
  Gene Symbol: MANEA
  Gene Name: mannosidase, endo-alpha
  ENSP ID: ENSP00000477554
MAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDPRIAKNYPQGRHNPPDDIGSSFYPELGSYSSRDPSVIETHMRQMRSASIGNYCIYICVFVSVYMHINDFLCNFTS

SEQ ID NO: 49101 - protein, 235 aa, Homo sapiens
  Payload ID: 9835
  Gene Symbol: MANEAL
  Gene Name: mannosidase, endo-alpha-like
  Uniprot ID: Q5VSG8
  ENSP ID: ENSP00000328770
MITGSPQMTWCPPFWTPPISTASRYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 49102 - protein, 457 aa, Homo sapiens
  Payload ID: 9835
  Gene Symbol: MANEAL
  Gene Name: mannosidase, endo-alpha-like
  Uniprot ID: Q5VSG8
  ENSP ID: ENSP00000362136
MARRRRRACIALFLVLLFAFGTLMGLRTLKAPDGLPALGPGLELAPFERRPEGAPAPAARAPAAPAAPPPPPPPPRTADPGGSPGPAPAEAEPAPVQSLRVYSDLHAFYYSWYGSPRREGHYIHWDHVMVPHWDPKISASYPRGRHSPPDDLGSSFYPELGPYSSRDPEVLREHMTQLKEAAIGVLVLSWYPPGMADDNGEPSDDLVPAILDTAHQYSIQVAFHIQPYKGRDDITVHDNIKYIIDTYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 49103 - protein, 250 aa, Homo sapiens
  Payload ID: 9835
  Gene Symbol: MANEAL
  Gene Name: mannosidase, endo-alpha-like
  Uniprot ID: Q5VSG8
  ENSP ID: ENSP00000380755
MARRRRRACIALFLVLLFAFGTLMGLRTLKAPDGLPALGPGLELAPFERRPEGAPAPAARAPAAPAAPPPPPPPPRTADPGGSPGPAPAEAEPAPVQSLRVYSDLHAFYYSWYGSPRREGHYIHWDHVMVPHWDPKISASYPRGRHSPPDDLGSSFYPELGPYSSRDPEVLREHMTQLKEAAIGVLVLSWYPPGMADDNGEPSDDLVPAILDTAHQYSIQVAFHIQPYKGRDDITVHDNIKYIIDTTGKL

SEQ ID NO: 49104 - protein, 130 aa, Homo sapiens
  Payload ID: 9835
  Gene Symbol: MANEAL
  Gene Name: mannosidase, endo-alpha-like
  ENSP ID: ENSP00000432567
VYSDLHAFYYSWYGSPRREGHYIHWDHVMVPHWDPKISASYPRGRHSPPDDLGSSFYPELGPYSSRDPEVLREHMTQLKEAAIGVLVLSWYPPGMADDNGEPSDDLVPAILDTAHQYSIQVWLPWCILPL

SEQ ID NO: 49105 - protein, 263 aa, Homo sapiens
  Payload ID: 9835
  Gene Symbol: MANEAL
  Gene Name: mannosidase, endo-alpha-like
  ENSP ID: ENSP00000437312
MADDNGEPSDDLVPAILDTAHQYSIQVAFHIQPYKGRDDITVHDNIKYIIDTYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 49106 - protein, 445 aa, Homo sapiens
  Payload ID: 9836
  Gene Symbol: MGAT1
  Gene Name: mannosyl (alpha-1,3-)-glycoprotein beta-1,2-N-acetylglucosaminyltransferase
  Uniprot ID: P26572
  ENSP ID: ENSP00000311888
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPLTWEGYDPSWN

SEQ ID NO: 49107 - protein, 445 aa, Homo sapiens; identical to SEQ ID NO: 49106
  Payload ID: 9836
  Gene Symbol: MGAT1
  Gene Name: mannosyl (alpha-1,3-)-glycoprotein beta-1,2-N-acetylglucosaminyltransferase
  Uniprot ID: P26572
  ENSP ID: ENSP00000332073

SEQ ID NO: 49108 - protein, 445 aa, Homo sapiens; identical to SEQ ID NO: 49106
  Payload ID: 9836
  Gene Symbol: MGAT1
  Gene Name: mannosyl (alpha-1,3-)-glycoprotein beta-1,2-N-acetylglucosaminyltransferase
  Uniprot ID: P26572
  ENSP ID: ENSP00000377010

SEQ ID NO: 49109 - protein, 445 aa, Homo sapiens; identical to SEQ ID NO: 49106
  Payload ID: 9836
  Gene Symbol: MGAT1
  Gene Name: mannosyl (alpha-1,3-)-glycoprotein beta-1,2-N-acetylglucosaminyltransferase
  Uniprot ID: P26572
  ENSP ID: ENSP00000402838

SEQ ID NO: 49110 - protein, 445 aa, Homo sapiens; identical to SEQ ID NO: 49106
  Payload ID: 9836
  Gene Symbol: MGAT1
  Gene Name: mannosyl (alpha-1,3-)-glycoprotein beta-1,2-N-acetylglucosaminyltransferase
  Uniprot ID: P26572
  ENSP ID: ENSP00000404718

SEQ ID NO: 49111 - protein, 104 aa, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENSP ID: ENSP00000421738
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPA

SEQ ID NO: 49112 - protein, 103 aa, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENSP ID: ENSP00000422588
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAP

SEQ ID NO: 49113 - protein, 111 aa, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENSP ID: ENSP00000422906
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVI

SEQ ID NO: 49114 - protein, 95 aa, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENSP ID: ENSP00000423401
MLKKQSAGLVLWGAILFVAWNALLLLFFWTRPAPGRPPSVSALDGDPASLTREVIRLAQDAEVELERQRGLLQQIGDALSSQRGRVPTAAPPAQP

SEQ ID NO: 49115 - protein, 127 aa, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENSP ID: ENSP00000424382
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLH

SEQ ID NO: 49116 - protein, 199 aa, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENSP ID: ENSP00000424891
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQ

SEQ ID NO: 49117 - protein, 153 aa, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENSP ID: ENSP00000425988
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIA

SEQ ID NO: 49118 - protein, 115 aa, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENSP ID: ENSP00000427116
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDR

SEQ ID NO: 49119 - protein, 34 aa, Homo sapiens
  Payload ID: 9836
  Gene Symbol: MGAT1
  Gene Name: mannosyl (alpha-1,3-)-glycoprotein beta-1,2-N-acetylglucosaminyltransferase
  ENSP ID: ENSP00000427433
MLKKQSAGLVLWGAILFVAWNALLLLFFWTRPAP

SEQ ID NO: 49120 - protein, 535 aa, Homo sapiens
  Payload ID: 9837
  Gene Symbol: MGAT4A
  Gene Name: mannosyl (alpha-1,3-)-glycoprotein beta-1,4-N-acetylglucosaminyltransferase, isozyme A
  Uniprot ID: Q9UM21
  ENSP ID: ENSP00000264968
MRLRNGTVATALAFITSFLTLSWYTTWQNGKEKLIAYQREFLALKERLRIAEHRISQRSSELNTIVQQFKRVGAETNGSKDALNKFSDNTLKLLKELTSKKSLQVPSIYYHLPHLLKNEGSLQPAVQIGNGRTGVSIVMGIPTVKREVKSYLIETLHSLIDNLYPEEKLDCVIVVFIGETDIDYVHGVVANLEKEFSKEISSGLVEVISPPESYYPDLTNLKETFGDSKERVRWRTKQNLDYCFLMMYAQEKGIYYIQLEDDIIVKQNYFNTIKNFALQLSSEEWMILEFSQLGFIGKMFQAPDLTLIVEFIFMFYKEKPIDWLLDHILWVKVCNPEKDAKHCDRQKANLRIRFRPSLFQHVGLHSSLSGKIQKLTDKDYMKPLLLKIHVNPPAEVSTSLKVYQGHTLEKTYMGEDFFWAITPIAGDYILFKFDKPVNVESYLFHSGNQEHPGDILLNTTVEVLPFKSEGLEISKETKDKRLEDGYFRIGKFENGVAEGMVDPSLNPISAFRLSVIQNSAVWAILNEIHIKKATN

SEQ ID NO: 49121 - protein, 535 aa, Homo sapiens; identical to SEQ ID NO: 49120
  Payload ID: 9837
  Gene Symbol: MGAT4A
  Gene Name: mannosyl (alpha-1,3-)-glycoprotein beta-1,4-N-acetylglucosaminyltransferase, isozyme A
  Uniprot ID: Q9UM21
  ENSP ID: ENSP00000377127

SEQ ID NO: 49122 - protein, 535 aa, Homo sapiens; identical to SEQ ID NO: 49120
  Payload ID: 9837
  Gene Symbol: MGAT4A
  Gene Name: mannosyl (alpha-1,3-)-glycoprotein beta-1,4-N-acetylglucosaminyltransferase, isozyme A
  Uniprot ID: Q9UM21
  ENSP ID: ENSP00000386841

SEQ ID NO: 49123 - protein, 423 aa, Homo sapiens
  Payload ID: 9837
  Gene Symbol: MGAT4A
  Gene Name: mannosyl (alpha-1,3-)-glycoprotein beta-1,4-N-acetylglucosaminyltransferase, isozyme A
  Uniprot ID: Q9UM21
  ENSP ID: ENSP00000404889
MNYSITVSIVMGIPTVKREVKSYLIETLHSLIDNLYPEEKLDCVIVVFIGETDIDYVHGVVANLEKEFSKEISSGLVEVISPPESYYPDLTNLKETFGDSKERVRWRTKQNLDYCFLMMYAQEKGIYYIQLEDDIIVKQNYFNTIKNFALQLSSEEWMILEFSQLGFIGKMFQAPDLTLIVEFIFMFYKEKPIDWLLDHILWVKVCNPEKDAKHCDRQKANLRIRFRPSLFQHVGLHSSLSGKIQKLTDKDYMKPLLLKIHVNPPAEVSTSLKVYQGHTLEKTYMGEDFFWAITPIAGDYILFKFDKPVNVESYLFHSGNQEHPGDILLNTTVEVLPFKSEGLEISKETKDKRLEDGYFRIGKFENGVAEGMVDPSLNPISAFRLSVIQNSAVWAILNEQRVFSGWWQKSRDKAEGPQAPLLF

SEQ ID NO: 49124 - protein, 44 aa, Homo sapiens
  Payload ID: 9837
  Gene Symbol: MGAT4A
  Gene Name: mannosyl (alpha-1,3-)-glycoprotein beta-1,4-N-acetylglucosaminyltransferase, isozyme A
  ENSP ID: ENSP00000475198
MRLRNGTVATALAFITSFLTLSWYTTWQNGKGKENDSENVHEMY

SEQ ID NO: 49125 - protein, 548 aa, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  Uniprot ID: Q9UQ53
  ENSP ID: ENSP00000292591
MRLRNGTFLTLLLFCLCAFLSLSWYAALSGQKGDVVDVYQREFLALRDRLHAAEQESLKRSKELNLVLDEIKRAVSERQALRDGDGNRTWGRLTEDPRLKPWNGSHRHVLHLPTVFHHLPHLLAKESSLQPAVRVGQGRTGVSVVMGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 49126 - protein, 563 aa, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  Uniprot ID: Q9UQ53
  ENSP ID: ENSP00000338487
MSRVAGTRTDVNELLQRWTPRCVRWHTGGARRVALDRPLVTACLPPAGDVVDVYQREFLALRDRLHAAEQESLKRSKELNLVLDEIKRAVSERQALRDGDGNRTWGRLTEDPRLKPWNGSHRHVLHLPTVFHHLPHLLAKESSLQPAVRVGQGRTGVSVVMGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 49127 - protein, 200 aa, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENSP ID: ENSP00000427995
MGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEK

SEQ ID NO: 49128 - protein, 244 aa, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENSP ID: ENSP00000428764
  MOD_RES (1)..(1): Any amino acid
XQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEWEHRAPGGQALQHVCGGAALRQPSVRQGGP

SEQ ID NO: 49129 - protein, 373 aa, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENSP ID: ENSP00000428906
  MOD_RES (1)..(1): Any amino acid
XEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 49130 - protein, 240 aa, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENSP ID: ENSP00000428960
  MOD_RES (1)..(1): Any amino acid
XKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 49131 - protein, 157 aa, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENSP ID: ENSP00000430376
MSRVAGTRTDVNELLQRWTPRCVRWHTGGARRVALDRPLVTACLPPAGDVVDVYQREFLALRDRLHAAEQESLKRSKELNLVLDEIKRAVSERQALRDGDGNRTWGRLTEDPRLKPWNGSHRHVLHLPTVFHHLPHLLAKESSLQPAVRVGQGRTGD

SEQ ID NO: 49132 - protein, 429 aa, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENSP ID: ENSP00000430721
  MOD_RES (1)..(1): Any amino acid
XEQESLKRSKELNLVLDEIKRAVSERQALRDGDGNRTWGRLTEDPRLKPWNGSHRHVLHLPTVFHHLPHLLAKESSLQPAVRVGQGRTGVSVVMGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGQRLWKAGAAEGACEPASRGEHEPEDIPALHPGESLPARGLLLGLHPCRGGLHPLPLLPTSKTGAVLLPQWEHRAPGGQALQHVCGGAALRQPSVRQGGPAGGPHRHPPVPSEPRRLPPDRLLLQGSGRGRGGPSLRPSGSTAPLDPDGLPCVGDSERDLPEKGRLSCGLLRVPCGQP

SEQ ID NO: 49133 - protein, 322 aa, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENSP ID: ENSP00000430723
  MOD_RES (1)..(1): Any amino acid
XFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAAGIKVGAHAITAVPPPLQDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSE

SEQ ID NO: 49134 - protein, 150 aa, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENSP ID: ENSP00000430964
  MOD_RES (1)..(1): Any amino acid
XLLLFCLCAFLSLSWYAALSGQKGDVVDVYQREFLALRDRLHAAEQESLKRSKELNLVLDEIKRAVSERQALRDGDGNRTWGRLTGPPIEAVERLTPARAAPAHRLPSPATPAGQGEQSAARGARGPGPHRSVGGDGHPERAARGALVPD

SEQ ID NO: 49135 - protein, 307 aa, Homo sapiens
  Payload ID: 9838
  Gene Symbol: MGAT4B
  Gene Name: mannosyl (alpha-1,3-)-glycoprotein beta-1,4-N-acetylglucosaminyltransferase, isozyme B
  ENSP ID: ENSP00000431093
  MOD_RES (1)..(1): Any amino acid
XTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIARGHSLLAGWQDPETEGQRLWKAGAAEGACEPASRGEHEPEDIPALHPGESLPARGLLLGLHPCRGGLHPLPLLPTSKTGAVLLPQWEHRAPGGQALQHVCGGAALRQPSVRQGGPAGGPHRHPPVPSEPRRLPPDRLLLQGSGRGRGGPSLRPSGSTAPLDPDGLPCVGDSERDLPEKGRLSCGLLRVPCGQP

SEQ ID NO: 49136 - protein, 447 aa, Homo sapiens
  Payload ID: 9839
  Gene Symbol: MGAT2
  Gene Name: mannosyl (alpha-1,6-)-glycoprotein beta-1,2-N-acetylglucosaminyltransferase
  Uniprot ID: Q10469
  ENSP ID: ENSP00000307423
MRFRIYKRKVLILTLVVAACGFVLWSSNGRQRKNEALAPPLLDAEPARGAGGRGGDHPSVAVGIRRVSNVSAASLVPAVPQPEADNLTLRYRSLVYQLNFDQTLRNVDKAGTWAPRELVLVVQVHNRPEYLRLLLDSLRKAQGIDNVLVIFSHDFWSTEINQLIAGVNFCPVLQVFFPFSIQLYPNEFPGSDPRDCPRDLPKNAALKLGCINAEYPDSFGHYREAKFSQTKHHWWWKLHFVWERVKILRDYAGLILFLEEDHYLAPDFYHVFKKMWKLKQQECPECDVLSLGTYSASRSFYGMADKVDVKTWKSTEHNMGLALTRNAYQKLIECTDTFCTYDDYNWDWTLQYLTVSCLPKFWKVLVPQIPRIFHAGDCGMHHKKTCRPSTQSAQIESLLNNNKQYMFPETLTISEKFTVVAISPPRKNGGWGDIRDHELCKSYRRLQ

SEQ ID NO: 49137 - protein, 741 aa, Homo sapiens
  Payload ID: 9840
  Gene Symbol: MGAT5
  Gene Name: mannosyl (alpha-1,6-)-glycoprotein beta-1,6-N-acetyl-glucosaminyltransferase
  Uniprot ID: Q09328
  ENSP ID: ENSP00000281923
MALFTPWKLSSQKLGFFLVTFGFIWGMMLLHFTIQQRTQPESSSMLREQILDLSKRYIKALAEENRNVVDGPYAGVMTAYDLKKTLAVLLDNILQRIGKLESKVDNLVVNGTGTNSTNSTTAVPSLVALEKINVADIINGAQEKCVLPPMDGYPHCEGKIKWMKDMWRSDPCYADYGVDGSTCSFFIYLSEVENWCPHLPWRAKNPYEEADHNSLAEIRTDFNILYSMMKKHEEFRWMRLRIRRMADAWIQAIKSLAEKQNLEKRKRKKVLVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHANYAQSKGHKTPWGKWNLNPQQFYTMFPHTPDNSFLGFVVEQHLNSSDIHHINEIKRQNQSLVYGKVDSFWKNKKIYLDIIHTYMEVHATVYGSSTKNIPSYVKNHGILSGRDLQFLLRETKLFVGLGFPYEGPAPLEAIANGCAFLNPKFNPPKSSKNTDFFIGKPTLRELTSQHPYAEVFIGRPHVWTVDLNNQEEVEDAVKAILNQKIEPYMPYEFTCEGMLQRINAFIEKQDFCHGQVMWPPLSALQVKLAEPGQSCKQVCQESQLICEPSFFQHLNKDKDMLKYKVTCQSSELAKDILVPSFDPKNKHCVFQGDLLLFSCAGAHPRHQRVCPCRDFIKGQVALCKDCL

SEQ ID NO: 49138 - protein, 741 aa, Homo sapiens; identical to SEQ ID NO: 49137
  Payload ID: 9840
  Gene Symbol: MGAT5
  Gene Name: mannosyl (alpha-1,6-)-glycoprotein beta-1,6-N-acetyl-glucosaminyltransferase
  Uniprot ID: Q09328
  ENSP ID: ENSP00000386377

SEQ ID NO: 49139 - protein, 790 aa, Homo sapiens
  Payload ID: 9841
  Gene Symbol: MGAT5B
  Gene Name: mannosyl (alpha-1,6-)-glycoprotein beta-1,6-N-acetyl-glucosaminyltransferase, isozyme B
  Uniprot ID: Q3V5L5
  ENSP ID: ENSP00000301618
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 49140 - protein, 801 aa, Homo sapiens
  Payload ID: 9841
  Gene Symbol: MGAT5B
  Gene Name: mannosyl (alpha-1,6-)-glycoprotein beta-1,6-N-acetyl-glucosaminyltransferase, isozyme B
  Uniprot ID: Q3V5L5
  ENSP ID: ENSP00000391227
MHSFVKHLCSRYVVERQGTMALPALLTRLLPLRRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 49141 - protein, 483 aa, Homo sapiens
  Payload ID: 9841
  Gene Symbol: MGAT5B
  Gene Name: mannosyl (alpha-1,6-)-glycoprotein beta-1,6-N-acetyl-glucosaminyltransferase, isozyme B
  ENSP ID: ENSP00000455631
MHSFVKHLCSRYVVERQGTMALPALLTRLLPLRRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFREGEVPGHPEQIHGDPWHRVLREPAAPRGASLCEEPRPLTAA

SEQ ID NO: 49142 - protein, 792 aa, Homo sapiens
  Payload ID: 9841
  Gene Symbol: MGAT5B
  Gene Name: mannosyl (alpha-1,6-)-glycoprotein beta-1,6-N-acetyl-glucosaminyltransferase, isozyme B
  Uniprot ID: Q3V5L5
  ENSP ID: ENSP00000456037
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKLQGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 49143 - protein, 110 aa, Homo sapiens
  Payload ID: 9841
  Gene Symbol: MGAT5B
  Gene Name: mannosyl (alpha-1,6-)-glycoprotein beta-1,6-N-acetyl-glucosaminyltransferase, isozyme B
  ENSP ID: ENSP00000457614
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADR

SEQ ID NO: 49144 - protein, 533 aa, Homo sapiens
  Payload ID: 9842
  Gene Symbol: MGAT3
  Gene Name: mannosyl (beta-1,4-)-glycoprotein beta-1,4-N-acetylglucosaminyltransferase
  Uniprot ID: Q09327
  ENSP ID: ENSP00000345270
MKMRRYKLFLMFCMAGLCLISFLHFFKTLSYVTFPRELASLSPNLVSSFFWNNAPVTPQASPEPGGPDLLRTPLYSHSPLLQPLPPSKAAEELHRVDLVLPEDTTEYFVRTKAGGVCFKPGTKMLERPPPGRPEEKPEGANGSSARRPPRYLLSARERTGGRGARRKWVECVCLPGWHGPSCGVPTVVQYSNLPTKERLVPREVPRRVINAINVNHEFDLLDVRFHELGDVVDAFVVCESNFTAYGEPRPLKFREMLTNGTFEYIRHKVLYVFLDHFPPGGRQDGWIADDYLRTFLTQDGVSRLRNLRPDDVFIIDDADEIPARDGVLFLKLYDGWTEPFAFHMRKSLYGFFWKQPGTLEVVSGCTVDMLQAVYGLDGIRLRRRQYYTMPNFRQYENRTGHILVQWSLGSPLHFAGWHCSWCFTPEGIYFKLVSAQNGDFPRWGDYEDKRDLNYIRGLIRTGGWFDGTQQEYPPADPSEHMYAPKYLLKNYDRFHYLLDNPYQEPRSTAAGGWRHRGPEGRPPARGKLDEAEV

SEQ ID NO: 49145 - protein, 108 aa, Homo sapiens
  Payload ID: 9842
  Gene Symbol: MGAT3
  Gene Name: mannosyl (beta-1,4-)-glycoprotein beta-1,4-N-acetylglucosaminyltransferase
  ENSP ID: ENSP00000408075
MESCSCHPGSGVQWRDHGSLQLPPPGFKMKMRRYKLFLMFCMAGLCLISFLHFFKTLSYVTFPRELASLSPNLVSSFFWNNAPVTPQASPEPGGPDLLRTPLYSHSPL

SEQ ID NO: 49146 - protein, 161 aa, Homo sapiens
  Payload ID: 9842
  Gene Symbol: MGAT3
  Gene Name: mannosyl (beta-1,4-)-glycoprotein beta-1,4-N-acetylglucosaminyltransferase
  ENSP ID: ENSP00000416226
MKMRRYKLFLMFCMAGLCLISFLHFFKTLSYVTFPRELASLSPNLVSSFFWNNAPVTPQASPEPGGPDLLRTPLYSHSPLLQPLPPSKAAEELHRVDLVLPEDTTEYFVRTKAGGVCFKPGTKMLERPPPGRPEEKPEGANGSSARRPPRYLLSARERTGG

SEQ ID NO: 49147 - protein, 837 aa, Homo sapiens
  Payload ID: 9843
  Gene Symbol: MOGS
  Gene Name: mannosyl-oligosaccharide glucosidase
  Uniprot ID: Q13724
  ENSP ID: ENSP00000233616
MARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 49148 - protein, 209 aa, Homo sapiens
  Payload ID: 9843
  Gene Symbol: MOGS
  Gene Name: mannosyl-oligosaccharide glucosidase
  ENSP ID: ENSP00000386493
MARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSATMSSGPPTQDCPC

SEQ ID NO: 49149 - protein, 731 aa, Homo sapiens
  Payload ID: 9843
  Gene Symbol: MOGS
  Gene Name: mannosyl-oligosaccharide glucosidase
  Uniprot ID: Q13724
  ENSP ID: ENSP00000388201
MKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 49150 - protein, 145 aa, Homo sapiens
  Payload ID: 9843
  Gene Symbol: MOGS
  Gene Name: mannosyl-oligosaccharide glucosidase
  ENSP ID: ENSP00000396298
MWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFW

SEQ ID NO: 49151 - protein, 491 aa, Homo sapiens
  Payload ID: 9843
  Gene Symbol: MOGS
  Gene Name: mannosyl-oligosaccharide glucosidase
  ENSP ID: ENSP00000410992
MKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERH

SEQ ID NO: 49152 - protein, 397 aa, Homo sapiens
  Payload ID: 9844
  Gene Symbol: MANSC1
  Gene Name: MANSC domain containing 1
  Uniprot ID: Q9H8J5
  ENSP ID: ENSP00000379638
MFFGGEGSLTYTLGIRGNEPVYTSTQEDCINSCCSTKNISGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 49153 - protein, 57 aa, Homo sapiens
  Payload ID: 9844
  Gene Symbol: MANSC1
  Gene Name: MANSC domain containing 1
  ENSP ID: ENSP00000437624
MFFGGEGSLTYTLVIICFLTLRLSASQNCLKKSLEDVVIDIQSSLSKGIRGNEPVYT

SEQ ID NO: 49154 - protein, 431 aa, Homo sapiens
  Payload ID: 9844
  Gene Symbol: MANSC1
  Gene Name: MANSC domain containing 1
  Uniprot ID: Q9H8J5
  ENSP ID: ENSP00000438205
MFFGGEGSLTYTLVIICFLTLRLSASQNCLKKSLEDVVIDIQSSLSKGIRGNEPVYTSTQEDCINSCCSTKNISGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 49155 - protein, 350 aa, Homo sapiens
  Payload ID: 9844
  Gene Symbol: MANSC1
  Gene Name: MANSC domain containing 1
  ENSP ID: ENSP00000445303
MIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 49156 - protein, 57 aa, Homo sapiens; identical to SEQ ID NO: 49153
  Payload ID: 9844
  Gene Symbol: MANSC1
  Gene Name: MANSC domain containing 1
  ENSP ID: ENSP00000486216

SEQ ID NO: 49157 - protein, 350 aa, Homo sapiens; identical to SEQ ID NO: 49155
  Payload ID: 9844
  Gene Symbol: MANSC1
  Gene Name: MANSC domain containing 1
  ENSP ID: ENSP00000487019

SEQ ID NO: 49158 - protein, 397 aa, Homo sapiens; identical to SEQ ID NO: 49152
  Payload ID: 9844
  Gene Symbol: MANSC1
  Gene Name: MANSC domain containing 1
  Uniprot ID: Q9H8J5
  ENSP ID: ENSP00000487244

SEQ ID NO: 49159 - protein, 431 aa, Homo sapiens; identical to SEQ ID NO: 49154
  Payload ID: 9844
  Gene Symbol: MANSC1
  Gene Name: MANSC domain containing 1
  Uniprot ID: Q9H8J5
  ENSP ID: ENSP00000487587

SEQ ID NO: 49160 - protein, 340 aa, Homo sapiens
  Payload ID: 9845
  Gene Symbol: MANSC4
  Gene Name: MANSC domain containing 4
  Uniprot ID: A6NHS7
  ENSP ID: ENSP00000370673
MHVAEVAVNVILLLSMGWTSDSLCSPTIFYRDCWIRRFPGLLINLEESQKLGAQFLKYYSESTGQKCSRSCCLRKDVSCNLAVFYHSPIHDNINCLHVHCPTLESCILEPGTSAILYNITDGIDPDLLVFEQSPTYLNTRSSSNRWDRLRILKAMNLDKQTTTINGMLPSTEAPSSTTHQDLVVNTNSTSYSKELTTDFWARFTSLNESITTKINKVSPSTDFISNPDNKTISPFFEPIDTKLSHMPVPPGLNSSKQLLNKTKGYNSRNHTSANEDEVSVTSKTWLVSVALCTSVIFLGCCIVILASGCCGKQQGQYKPGQRKSGSLQIKNRNHMKENSS

SEQ ID NO: 49161 - protein, 112 aa, Homo sapiens
  Payload ID: 9846
  Gene Symbol: MKNK1
  Gene Name: MAP kinase interacting serine/threonine kinase 1
  ENSP ID: ENSP00000339197
MQNIPEMGSSEPLPIADGDRRRKKKRRGRATDSLPGKFEDMYKLTSELLGEGAYAKVQGAVSLQNGKEYAVKIIEKQAGHSRSRVFREVETLYQCQGNKFHLSPHPEAKALQ

SEQ ID NO: 49162 - protein, 329 aa, Homo sapiens
  Payload ID: 9846
  Gene Symbol: MKNK1
  Gene Name: MAP kinase interacting serine/threonine kinase 1
  ENSP ID: ENSP00000339573
MAKSMPSKSSRNKQGTVGVGCFERWRRCISVRETSSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 49163 - protein, 424 aa, Homo sapiens
  Payload ID: 9846
  Gene Symbol: MKNK1
  Gene Name: MAP kinase interacting serine/threonine kinase 1
  Uniprot ID: Q9BUB5
  ENSP ID: ENSP00000361013
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 49164 - protein, 465 aa, Homo sapiens
  Payload ID: 9846
  Gene Symbol: MKNK1
  Gene Name: MAP kinase interacting serine/threonine kinase 1
  Uniprot ID: Q9BUB5
  ENSP ID: ENSP00000361014
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKDKVSLCHLGWSAMAPSGLTAAPTSLGSSDPPTSASQVAGTTGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 49165 - protein, 347 aa, Homo sapiens
  Payload ID: 9846
  Gene Symbol: MKNK1
  Gene Name: MAP kinase interacting serine/threonine kinase 1
  Uniprot ID: Q9BUB5
  ENSP ID: ENSP00000411135
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGEQQHNGPDALRS

SEQ ID NO: 49166 - protein, 171 aa, Homo sapiens
  Payload ID: 9846
  Gene Symbol: MKNK1
  Gene Name: MAP kinase interacting serine/threonine kinase 1
  ENSP ID: ENSP00000431837
MGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEK

SEQ ID NO: 49167 - protein, 126 aa, Homo sapiens
  Payload ID: 9846
  Gene Symbol: MKNK1
  Gene Name: MAP kinase interacting serine/threonine kinase 1
  ENSP ID: ENSP00000431985
MILGHCSLDLLGSSNPPTSASQAATGFHVRGRWRTEDCHLRTKAIETLRVAGRHQLPDRSFISFGISSLQMVSSQKLEKPIEMGSSEPLPIADGDRRRKKKRRGRATDSLPGKFEDMYKLTSELLG

SEQ ID NO: 49168 - protein, 37 aa, Homo sapiens
  Payload ID: 9846
  Gene Symbol: MKNK1
  Gene Name: MAP kinase interacting serine/threonine kinase 1
  ENSP ID: ENSP00000432369
MVSSQKLEKPIVSETTLQVPFPRKVLTICPFWRTLFH

SEQ ID NO: 49169 - protein, 143 aa, Homo sapiens
  Payload ID: 9846
  Gene Symbol: MKNK1
  Gene Name: MAP kinase interacting serine/threonine kinase 1
  ENSP ID: ENSP00000432665
MQNIPEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASR

SEQ ID NO: 49170 - protein, 118 aa, Homo sapiens [sequence omitted]

SEQ ID NO: 49171 - protein, 100 aa, Homo sapiens
  Payload ID: 9846
  Gene Symbol: MKNK1
  Gene Name: MAP kinase interacting serine/threonine kinase 1
  ENSP ID: ENSP00000434021
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQ

SEQ ID NO: 49172 - protein, 60 aa, Homo sapiens
  Payload ID: 9846
  Gene Symbol: MKNK1
  Gene Name: MAP kinase interacting serine/threonine kinase 1
  ENSP ID: ENSP00000434051
MVSSQKLEKPIEMGSSEPLPIADGDRRRKKKRRGRATDSLPGKFEDVILPSAIPGGAAER

SEQ ID NO: 49173 - protein, 56 aa, Homo sapiens
  Payload ID: 9846
  Gene Symbol: MKNK1
  Gene Name: MAP kinase interacting serine/threonine kinase 1
  ENSP ID: ENSP00000434493
MVSSQKLEKPIEMGSSEPLPIADGDRRRKKKRRGRATDSLPGKFEDHRETSRAQSE

SEQ ID NO: 49174 - protein, 91 aa, Homo sapiens
  Payload ID: 9846
  Gene Symbol: MKNK1
  Gene Name: MAP kinase interacting serine/threonine kinase 1
  ENSP ID: ENSP00000434834
MVSSQKLEKPIEMGSSEPLPIADGDRRRKKKRRGRATDSLPGKFEDMYKLTSELLGEGAYAKVQGAVSLQNGKEYAVKVSVSAECQALLCK

SEQ ID NO: 49175 - protein, 85 aa, Homo sapiens
  Payload ID: 9846
  Gene Symbol: MKNK1
  Gene Name: MAP kinase interacting serine/threonine kinase 1
  ENSP ID: ENSP00000435069
  MOD_RES (1)..(1): Any amino acid
XTPELTTPCGSAEYMAPEVVEVFTDQATFYDKRCDLWSLGVVLYIMLSGYPPFVGHCGADCGWDRGEVCRVCQEQQHNGPDALRS

SEQ ID NO: 49176 - protein, 101 aa, Homo sapiens
  Payload ID: 9846
  Gene Symbol: MKNK1
  Gene Name: MAP kinase interacting serine/threonine kinase 1
  ENSP ID: ENSP00000435163
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQC

SEQ ID NO: 49177 - protein, 178 aa, Homo sapiens
  Payload ID: 9846
  Gene Symbol: MKNK1
  Gene Name: MAP kinase interacting serine/threonine kinase 1
  ENSP ID: ENSP00000436709
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILC

SEQ ID NO: 49178 - protein, 465 aa, Homo sapiens
  Payload ID: 9847
  Gene Symbol: MKNK2
  Gene Name: MAP kinase interacting serine/threonine kinase 2
  Uniprot ID: Q9HBH9
  ENSP ID: ENSP00000250896
MVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 49179 - protein, 414 aa, Homo sapiens
  Payload ID: 9847
  Gene Symbol: MKNK2
  Gene Name: MAP kinase interacting serine/threonine kinase 2
  Uniprot ID: Q9HBH9
  ENSP ID: ENSP00000309485
MVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRWDSHFLLPPHPCRIHVRPGGLVRTVTVNE

SEQ ID NO: 49180 - protein, 129 aa, Homo sapiens
  Payload ID: 9847
  Gene Symbol: MKNK2
  Gene Name: MAP kinase interacting serine/threonine kinase 2
  ENSP ID: ENSP00000464828
MAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQR

SEQ ID NO: 49181 - protein, 176 aa, Homo sapiens
  Payload ID: 9847
  Gene Symbol: MKNK2
  Gene Name: MAP kinase interacting serine/threonine kinase 2
  ENSP ID: ENSP00000465079
NILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQR

SEQ ID NO: 49182 - protein, 82 aa, Homo sapiens
  Payload ID: 9847
  Gene Symbol: MKNK2
  Gene Name: MAP kinase interacting serine/threonine kinase 2
  ENSP ID: ENSP00000465425
MVQKKPAELQGFHRSFKGQNPFELAFSLDQPDHGDSDFGLQCSARPDMPASQPIDIPDAKKRGKKKKRGRATDSFSGRFEDH

SEQ ID NO: 49183 - protein, 158 aa, Homo sapiens
  Payload ID: 9847
  Gene Symbol: MKNK2
  Gene Name: MAP kinase interacting serine/threonine kinase 2
  ENSP ID: ENSP00000465645
MAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRWDSHFLLPPHPCRIHVRPGGLVRTVTVNE

SEQ ID NO: 49184 - protein, 73 aa, Homo sapiens
  Payload ID: 9847
  Gene Symbol: MKNK2
  Gene Name: MAP kinase interacting serine/threonine kinase 2
  ENSP ID: ENSP00000466064
MVQKKPAELQGFHRSFKGQNPFELAFSLDQPDHGDSDFGLQCSARPGEGPEGEEGTGQLLSLPWQWPAPAGGW

SEQ ID NO: 49185 - protein, 76 aa, Homo sapiens
  Payload ID: 9847
  Gene Symbol: MKNK2
  Gene Name: MAP kinase interacting serine/threonine kinase 2
  ENSP ID: ENSP00000466147
MVQKKPAELQGFHRSFKGQNPFELAFSLDQPDHGDSDFGLQCSARPGEGPEGEEGTGQLLSLPWQWPAPAGGWGHA

SEQ ID NO: 49186 - protein, 43 aa, Homo sapiens
  Payload ID: 9847
  Gene Symbol: MKNK2
  Gene Name: MAP kinase interacting serine/threonine kinase 2
  ENSP ID: ENSP00000466594
  MOD_RES (1)..(1): Any amino acid
XRTCCLRASRRASTSSPTRTGPTSPALPKTSSPSCWSVTPSRG

SEQ ID NO: 49187 - protein, 465 aa, Homo sapiens; identical to SEQ ID NO: 49178
  Payload ID: 9847
  Gene Symbol: MKNK2
  Gene Name: MAP kinase interacting serine/threonine kinase 2
  Uniprot ID: Q9HBH9
  ENSP ID: ENSP00000467811

SEQ ID NO: 49188 - protein, 795 aa, Homo sapiens
  Payload ID: 9848
  Gene Symbol: MARK1
  Gene Name: MAP/microtubule affinity-regulating kinase 1
  Uniprot ID: Q9P0L2
  ENSP ID: ENSP00000355884
MSARTPLPTVNERDTENHTSVDGYTEPHIQPTKSSSRQNIPRCRNSITSATDEQPHIGNYRLQKTIGKGNFAKVKLARHVLTGREVAVKIIDKTQLNPTSLQKLFREVRIMKILNHPNIVKLFEVIETEKTLYLVMEYASGGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRDPSEGEASGRTDTSRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 49189 - protein, 758 aa, Homo sapiens
  Payload ID: 9848
  Gene Symbol: MARK1
  Gene Name: MAP/microtubule affinity-regulating kinase 1
  Uniprot ID: Q9P0L2
  ENSP ID: ENSP00000355885
MSARTPLPTVNERDTENHTSVDGYTEPHIQPTKSSSRQNIPRCRNSITSATDEQPHIGNYRLQKTIGKGNFAKVKLARHVLTGREVAVKIIDKTQLNPTSLQKLFREVRIMKILNHPNIGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 49190 - protein, 780 aa, Homo sapiens
  Payload ID: 9848
  Gene Symbol: MARK1
  Gene Name: MAP/microtubule affinity-regulating kinase 1
  ENSP ID: ENSP00000386017
MSARTPLPTVNERDTENHTSVDGYTEPHIQPTKSSSRQNIPRCRNSITSATDEQPHIGNYRLQKTIGKGNFAKVKLARHVLTGREVAVKIIDKTQLNPTSLQKLFREVRIMKILNHPNIVKLFEVIETEKTLYLVMEYASGGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 49191 - protein, 796 aa, Homo sapiens
  Payload ID: 9848
  Gene Symbol: MARK1
  Gene Name: MAP/microtubule affinity-regulating kinase 1
  ENSP ID: ENSP00000483424
MSARTPLPTVNERDTENHTSVDGYTEPHIQPTKSSSRQNIPRCRNSITSATDEQPHIGNYRLQKTIGKGNFAKVKLARHVLTGREVAVKIIDKTQLNPTSLQKLFREVRIMKILNHPNIVKLFEVIETEKTLYLVMEYASGGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGSTTQRVPAASPSAHSISTATPDRTRFPRGSSSRSTFHGEQLRERRSVAYNGPPASPSHETGAFAHARRGTSTGIISKITSKFVRRDPSEGEASGRTDTSRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 49192 - protein, 709 aa, Homo sapiens
  Payload ID: 9849
  Gene Symbol: MARK2
  Gene Name: MAP/microtubule affinity-regulating kinase 2
  Uniprot ID: Q7KZI7
  ENSP ID: ENSP00000294247
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 49193 - protein, 719 aa, Homo sapiens
  Payload ID: 9849
  Gene Symbol: MARK2
  Gene Name: MAP/microtubule affinity-regulating kinase 2
  Uniprot ID: Q7KZI7
  ENSP ID: ENSP00000355091
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLSFRFARRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 49194 - protein, 699 aa, Homo sapiens
  Payload ID: 9849
  Gene Symbol: MARK2
  Gene Name: MAP/microtubule affinity-regulating kinase 2
  ENSP ID: ENSP00000367041
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 49195 - protein, 788 aa, Homo sapiens
  Payload ID: 9849
  Gene Symbol: MARK2
  Gene Name: MAP/microtubule affinity-regulating kinase 2
  Uniprot ID: Q7KZI7
  ENSP ID: ENSP00000385751
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLSFRFARRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 49196 - protein, 691 aa, Homo sapiens
  Payload ID: 9849
  Gene Symbol: MARK2
  Gene Name: MAP/microtubule affinity-regulating kinase 2
  Uniprot ID: Q7KZI7
  ENSP ID: ENSP00000386128
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 49197 - protein, 699 aa, Homo sapiens; identical to SEQ ID NO: 49194
  Payload ID: 9849
  Gene Symbol: MARK2
  Gene Name: MAP/microtubule affinity-regulating kinase 2
  ENSP ID: ENSP00000415494

SEQ ID NO: 49198 - protein, 755 aa, Homo sapiens
  Payload ID: 9849
  Gene Symbol: MARK2
  Gene Name: MAP/microtubule affinity-regulating kinase 2
  Uniprot ID: Q7KZI7
  ENSP ID: ENSP00000421075
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLSFRFARRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 49199 - protein, 778 aa, Homo sapiens
  Payload ID: 9849
  Gene Symbol: MARK2
  Gene Name: MAP/microtubule affinity-regulating kinase 2
  ENSP ID: ENSP00000423452
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 49200 - protein, 60 aa, Homo sapiens
  Payload ID: 9849
  Gene Symbol: MARK2
  Gene Name: MAP/microtubule affinity-regulating kinase 2
  ENSP ID: ENSP00000423844
MEVAGSPFPFLQSVACLLTLAHIPAVGNILQHRRRGAGPTLGHLDSKPSSKSNMIRGRNS

SEQ ID NO: 49201 - protein, 745 aa, Homo sapiens
  Payload ID: 9849
  Gene Symbol: MARK2
  Gene Name: MAP/microtubule affinity-regulating kinase 2
  Uniprot ID: Q7KZI7
  ENSP ID: ENSP00000423974
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 49202 - protein, 724 aa, Homo sapiens
  Payload ID: 9849
  Gene Symbol: MARK2
  Gene Name: MAP/microtubule affinity-regulating kinase 2
  Uniprot ID: Q7KZI7
  ENSP ID: ENSP00000425765
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 49203 - protein, 111 aa, Homo sapiens
  Payload ID: 9849
  Gene Symbol: MARK2
  Gene Name: MAP/microtubule affinity-regulating kinase 2
  ENSP ID: ENSP00000437509
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAH

SEQ ID NO: 49204 - protein, 91 aa, Homo sapiens
  Payload ID: 9849
  Gene Symbol: MARK2
  Gene Name: MAP/microtubule affinity-regulating kinase 2
  ENSP ID: ENSP00000444859
MGGQRNTSVGNIVQRWRDHVVCQKAGVIYSGRKAQEHGTGRTDFTPAQRLMMPTLGHLDSKPSSKSNMIRGRNSATSADEQPHIGNYRLLK

SEQ ID NO: 49205 - protein, 161 aa, Homo sapiens
  Payload ID: 9849
  Gene Symbol: MARK2
  Gene Name: MAP/microtubule affinity-regulating kinase 2
  ENSP ID: ENSP00000444956
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADF

SEQ ID NO: 49206 - protein, 713 aa, Homo sapiens
  Payload ID: 9850
  Gene Symbol: MARK3
  Gene Name: MAP/microtubule affinity-regulating kinase 3
  ENSP ID: ENSP00000216288
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSEVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 49207 - protein, 729 aa, Homo sapiens
  Payload ID: 9850
  Gene Symbol: MARK3
  Gene Name: MAP/microtubule affinity-regulating kinase 3
  Uniprot ID: P27448
  ENSP ID: ENSP00000303698
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 49208 - protein, 776 aa, Homo sapiens
  Payload ID: 9850
  Gene Symbol: MARK3
  Gene Name: MAP/microtubule affinity-regulating kinase 3
  ENSP ID: ENSP00000335347
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQGCQAGQTIKVQVSFDLLSLMFTFIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRNMSFRFIKRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 49209 - protein, 659 aa, Homo sapiens
  Payload ID: 9850
  Gene Symbol: MARK3
  Gene Name: MAP/microtubule affinity-regulating kinase 3
  ENSP ID: ENSP00000402104
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRNMSFRFIKSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 49210 - protein, 752 aa, Homo sapiens
  Payload ID: 9850
  Gene Symbol: MARK3
  Gene Name: MAP/microtubule affinity-regulating kinase 3
  ENSP ID: ENSP00000408092
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQGCQAGQTIKVQVSFDLLSLMFTFIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 49211 - protein, 753 aa, Homo sapiens
  Payload ID: 9850
  Gene Symbol: MARK3
  Gene Name: MAP/microtubule affinity-regulating kinase 3
  ENSP ID: ENSP00000411397
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRNMSFRFIKRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 49212 - protein, 505 aa, Homo sapiens
  Payload ID: 9850
  Gene Symbol: MARK3
  Gene Name: MAP/microtubule affinity-regulating kinase 3
  ENSP ID: ENSP00000450460
  MOD_RES (1)..(1): Any amino acid
XVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSEVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRNMSFRFIKRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 49213 - protein, 744 aa, Homo sapiens
  Payload ID: 9850
  Gene Symbol: MARK3
  Gene Name: MAP/microtubule affinity-regulating kinase 3
  Uniprot ID: P27448
  ENSP ID: ENSP00000450772
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 49214 - protein, 331 aa, Homo sapiens
  Payload ID: 9850
  Gene Symbol: MARK3
  Gene Name: MAP/microtubule affinity-regulating kinase 3
  ENSP ID: ENSP00000451623
APASPMLGNASNPNKADIPERKKSSTVPSSNTASGGMTRRNTYVCSERTTADRHSVIQNGKENSLTEMFAYAASPASVCTSTCRLRHQKSMSMSASGHPKMMLPPIDSEGDNFKAITIPDQRTPVASTHSISSAATPDRIRFPRGTASRSTFHGQPRERRTATYNGPPASPSLSHEATPLSQTRSRGSTNLFSKLTSKLTRRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 49215 - protein, 129 aa, Homo sapiens
  Payload ID: 9850
  Gene Symbol: MARK3
  Gene Name: MAP/microtubule affinity-regulating kinase 3
  ENSP ID: ENSP00000452829
MDCANHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGKNI

SEQ ID NO: 49216 - protein, 222 aa, Homo sapiens
  Payload ID: 9850
  Gene Symbol: MARK3
  Gene Name: MAP/microtubule affinity-regulating kinase 3
  ENSP ID: ENSP00000452893
AGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 49217 - protein, 178 aa, Homo sapiens
  Payload ID: 9850
  Gene Symbol: MARK3
  Gene Name: MAP/microtubule affinity-regulating kinase 3
  ENSP ID: ENSP00000454169
MSTRTPLPTVNERDTENHTSHGDGRQEVTSRTSRSGARCRNSIASCADEQPHIGNYRLLKTIGKGNFAKVKLARHILTGRELFREVRIMKILNHPNIVKLFEVIETEKTLYLIMEYASGGEVFDYLVAHGRMKEKEARSKFRQIVSAVQYCHQKRIVHRDLKAENLLLDADMNIKIAD

SEQ ID NO: 49218 - protein, 752 aa, Homo sapiens
  Payload ID: 9851
  Gene Symbol: MARK4
  Gene Name: MAP/microtubule affinity-regulating kinase 4
  Uniprot ID: Q96L34
  ENSP ID: ENSP00000262891
MSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVADEPERIGGPEVTSCHLPWDQTETAPRLLRFPWSVKLTSSRPPEALMAALRQATAAARCRCRQPQPFLLACLHGGAGGPEPLSHFEVEVCQLPRPGLRGVLFRRVAGTALAFRTLVTRISNDLEL

SEQ ID NO: 49219 - protein, 688 aa, Homo sapiens
  Payload ID: 9851
  Gene Symbol: MARK4
  Gene Name: MAP/microtubule affinity-regulating kinase 4
  Uniprot ID: Q96L34
  ENSP ID: ENSP00000300843
MSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVTLDPSKRQNSNRCVSGASLPQGSKIRSQTNLRESGDLRSQVAIYLGIKRKPPPGCSDSPGV

SEQ ID NO: 49220 - protein, 62 aa, Homo sapiens
  Payload ID: 9851
  Gene Symbol: MARK4
  Gene Name: MAP/microtubule affinity-regulating kinase 4
  ENSP ID: ENSP00000465414
MKGLNHPNIVKLFEVIETEKTLYLVMEYASAGEVFDYLVSHGRMKEKEARAKFRQIVSAVHY

SEQ ID NO: 49221 - protein, 74 aa, Homo sapiens
  Payload ID: 9851
  Gene Symbol: MARK4
  Gene Name: MAP/microtubule affinity-regulating kinase 4
  ENSP ID: ENSP00000465613
MKGLNHPNIVKLFEVIETEKTLYLVMEYASAGEVFDYLVSHGRMKEKEARAKFRQIVSAVHYCHQKNIVHRDLK

SEQ ID NO: 49222 - protein, 97 aa, Homo sapiens
  Payload ID: 9851
  Gene Symbol: MARK4
  Gene Name: MAP/microtubule affinity-regulating kinase 4
  ENSP ID: ENSP00000466702
MSSRTVLAPGNDRNSDTAENLLLDAEANIKIADFGFSNEFTLGSKLDTFCGSPPYAAPELFQGKKYDGPEVDIWSLGVILYTLVSGSLPFDGHNLKR

SEQ ID NO: 49223 - protein, 48 aa, Homo sapiens
  Payload ID: 9851
  Gene Symbol: MARK4
  Gene Name: MAP/microtubule affinity-regulating kinase 4
  ENSP ID: ENSP00000466843
  MOD_RES (1)..(1): Any amino acid
XNLLLDAEANIKIADFGFSNEFTLGSKLDTFCGSPPYAAPELFQGKKL

SEQ ID NO: 49224 - protein, 97 aa, Homo sapiens; identical to SEQ ID NO: 49222
  Payload ID: 9851
  Gene Symbol: MARK4
  Gene Name: MAP/microtubule affinity-regulating kinase 4
  ENSP ID: ENSP00000480702

SEQ ID NO: 49225 - protein, 79 aa, Homo sapiens
  Payload ID: 9851
  Gene Symbol: MARK4
  Gene Name: MAP/microtubule affinity-regulating kinase 4
  ENSP ID: ENSP00000484974
MAALRQATAAARCRCRQPQPFLLACLHGGAGGPEPLSHFEVEVCQLPRPGLRGVLFRRVAGTALAFRTLVTRISNDLEL

SEQ ID NO: 49226 - protein, 343 aa, Homo sapiens
  Payload ID: 9852
  Gene Symbol: MBIP
  Gene Name: MAP3K12 binding inhibitory protein 1
  Uniprot ID: Q9NS73
  ENSP ID: ENSP00000324444
MAAATELNRPSSGDRNLERRCRPNLSREVLYEIFRSLHTLVGQLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTGGPVPRDIYQRIKKLEDKILELEGISPEYFQSVSFSGKRRKVQPPQNYSLAELDEKISALKQALLRKSREAESMATHHLP

SEQ ID NO: 49227 - protein, 282 aa, Homo sapiens
  Payload ID: 9852
  Gene Symbol: MBIP
  Gene Name: MAP3K12 binding inhibitory protein 1
  Uniprot ID: Q9NS73
  ENSP ID: ENSP00000352517
MAAATELNRPSSGDRNLERRCRPNLSREVLYEIFRSLHTLVGQLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTELFWKKKKSSTTSTELFTG

SEQ ID NO: 49228 - protein, 344 aa, Homo sapiens
  Payload ID: 9852
  Gene Symbol: MBIP
  Gene Name: MAP3K12 binding inhibitory protein 1
  Uniprot ID: Q9NS73
  ENSP ID: ENSP00000399718
MAAATELNRPSSGDRNLERRCRPNLSREVLYEIFRSLHTLVGQLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTGGPVPRDIYQRIKKLEDKILELEGISPEYFQSVSFSGKRRKVQPPQQNYSLAELDEKISALKQALLRKSREAESMATHHLP

SEQ ID NO: 49229 - protein, 299 aa, Homo sapiens
  Payload ID: 9852
  Gene Symbol: MBIP
  Gene Name: MAP3K12 binding inhibitory protein 1
  ENSP ID: ENSP00000473739
  MOD_RES (1)..(1): Any amino acid
XTELNRPSSGDRNLERRCRPNLSREVLYEIFRSLHTLVGQLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTGGPVPRDIYQRIKKLEDKILELEGISPEYFQSVVSISVF

SEQ ID NO: 49230 - protein, 281 aa, Homo sapiens
  Payload ID: 9852
  Gene Symbol: MBIP
  Gene Name: MAP3K12 binding inhibitory protein 1
  ENSP ID: ENSP00000474535
MAAATELNRPSSGDRNLERRCRPNLSREVLYEIFRSLHTLVGQLDLRDDVVKITIDWNKLQSLSAFQPALLFSALEQHILYLQMELCCSQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTGGPVPRDIYQR

SEQ ID NO: 49231 - protein, 222 aa, Homo sapiens
  Payload ID: 9852
  Gene Symbol: MBIP
  Gene Name: MAP3K12 binding inhibitory protein 1
  ENSP ID: ENSP00000474583
MAAATELNRPSSGDRNLERRCRPNLSREVLYEIFRSLHTLVGQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQ

SEQ ID NO: 49232 - protein, 112 aa, Homo sapiens
  Payload ID: 9852
  Gene Symbol: MBIP
  Gene Name: MAP3K12 binding inhibitory protein 1
  ENSP ID: ENSP00000474845
MLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKA

SEQ ID NO: 49233 - protein, 298 aa, Homo sapiens
  Payload ID: 9852
  Gene Symbol: MBIP
  Gene Name: MAP3K12 binding inhibitory protein 1
  ENSP ID: ENSP00000484282
MAAATELNRPSSGDRNLERRCRPNLSREVLYEIFRSLHTLVGQLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTGGPVPRDIYQRIKKLEDKILELEGISPEYFQSVGL

SEQ ID NO: 49234 - protein, 242 aa, Homo sapiens
  Payload ID: 9853
  Gene Symbol: MAP3K7CL
  Gene Name: MAP3K7 C-terminal like
  Uniprot ID: P57077
  ENSP ID: ENSP00000286791
MVQLIAPLEVMWNEAADLKPLALSRRLECSGGIMAHYSPDLLGPEMESRYFAQVGLEHLASSSPPAFGFLKCLDYSISVLCSATSLAMLEDNPKVSKLATGDWMLTLKPKSITVPVEIPSSPLDDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 49235 - protein, 242 aa, Homo sapiens; identical to SEQ ID NO: 49234
  Payload ID: 9853
  Gene Symbol: MAP3K7CL
  Gene Name: MAP3K7 C-terminal like
  Uniprot ID: P57077
  ENSP ID: ENSP00000343212

SEQ ID NO: 49236 - protein, 142 aa, Homo sapiens
  Payload ID: 9853
  Gene Symbol: MAP3K7CL
  Gene Name: MAP3K7 C-terminal like
  Uniprot ID: P57077
  ENSP ID: ENSP00000345777
MISTARVPADKPVRIAFSLNDASDDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 49237 - protein, 142 aa, Homo sapiens; identical to SEQ ID NO: 49236
  Payload ID: 9853
  Gene Symbol: MAP3K7CL
  Gene Name: MAP3K7 C-terminal like
  Uniprot ID: P57077
  ENSP ID: ENSP00000382809

SEQ ID NO: 49238 - protein, 142 aa, Homo sapiens; identical to SEQ ID NO: 49236
  Payload ID: 9853
  Gene Symbol: MAP3K7CL
  Gene Name: MAP3K7 C-terminal like
  Uniprot ID: P57077
  ENSP ID: ENSP00000382810

SEQ ID NO: 49239 - protein, 142 aa, Homo sapiens; identical to SEQ ID NO: 49236
  Payload ID: 9853
  Gene Symbol: MAP3K7CL
  Gene Name: MAP3K7 C-terminal like
  Uniprot ID: P57077
  ENSP ID: ENSP00000382812

SEQ ID NO: 49240 - protein, 142 aa, Homo sapiens; identical to SEQ ID NO: 49236
  Payload ID: 9853
  Gene Symbol: MAP3K7CL
  Gene Name: MAP3K7 C-terminal like
  Uniprot ID: P57077
  ENSP ID: ENSP00000382816

SEQ ID NO: 49241 - protein, 142 aa, Homo sapiens; identical to SEQ ID NO: 49236
  Payload ID: 9853
  Gene Symbol: MAP3K7CL
  Gene Name: MAP3K7 C-terminal like
  Uniprot ID: P57077
  ENSP ID: ENSP00000382817

SEQ ID NO: 49242 - protein, 242 aa, Homo sapiens; identical to SEQ ID NO: 49234
  Payload ID: 9853
  Gene Symbol: MAP3K7CL
  Gene Name: MAP3K7 C-terminal like
  Uniprot ID: P57077
  ENSP ID: ENSP00000382828

SEQ ID NO: 49243 - protein, 44 aa, Homo sapiens
  Payload ID: 9853
  Gene Symbol: MAP3K7CL
  Gene Name: MAP3K7 C-terminal like
  ENSP ID: ENSP00000402384
MVQLIAPLEVMWNEAADLKPLALSRRLECSGGIMAHYSPDLLGP

SEQ ID NO: 49244 - protein, 94 aa, Homo sapiens
  Payload ID: 9853
  Gene Symbol: MAP3K7CL
  Gene Name: MAP3K7 C-terminal like
  ENSP ID: ENSP00000411208
MISTARVPADKPVRIAFSLNDASDDTPPEDSIPLVFPELDQQLQPLPPCHDSEESMEVFKQHCQIAEEYHEVKKEITLLEQRKKELIAKLDQAE

SEQ ID NO: 49245 - protein, 136 aa, Homo sapiens
  Payload ID: 9853
  Gene Symbol: MAP3K7CL
  Gene Name: MAP3K7 C-terminal like
  ENSP ID: ENSP00000437846
MLVSSSSLTPFPPVRTADDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 49246 - protein, 199 aa, Homo sapiens
  Payload ID: 9854
  Gene Symbol: MAP6D1
  Gene Name: MAP6 domain containing 1
  Uniprot ID: Q9H9H5
  ENSP ID: ENSP00000314560
MAWPCISRLCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRQEFQAWTGVKPSRSTKTKPARVITTHTSGWDSSPGAGFQVPEVRKKFTPNPSAIFQASAPRILNV

SEQ ID NO: 49247 - protein, 182 aa, Homo sapiens
  Payload ID: 9854
  Gene Symbol: MAP6D1
  Gene Name: MAP6 domain containing 1
  ENSP ID: ENSP00000388945
MAWPCISRLCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRQEFQAWTGVKPSRSTKTKPARVITTHTSGWDSSPGAGFQASAPRILNV

SEQ ID NO: 49248 - protein, 133 aa, Homo sapiens
  Payload ID: 9854
  Gene Symbol: MAP6D1
  Gene Name: MAP6 domain containing 1
  ENSP ID: ENSP00000390816
  MOD_RES (1)..(1): Any amino acid
XCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRNSRLGLE

SEQ ID NO: 49249 - protein, 803 aa, Homo sapiens
  Payload ID: 9855
  Gene Symbol: MAP7D1
  Gene Name: MAP7 domain containing 1
  Uniprot ID: Q3KQU3
  ENSP ID: ENSP00000320228
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 49250 - protein, 808 aa, Homo sapiens
  Payload ID: 9855
  Gene Symbol: MAP7D1
  Gene Name: MAP7 domain containing 1
  Uniprot ID: Q3KQU3
  ENSP ID: ENSP00000362243
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 49251 - protein, 841 aa, Homo sapiens
  Payload ID: 9855
  Gene Symbol: MAP7D1
  Gene Name: MAP7 domain containing 1
  Uniprot ID: Q3KQU3
  ENSP ID: ENSP00000362244
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKQKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 49252 - protein, 244 aa, Homo sapiens
  Payload ID: 9855
  Gene Symbol: MAP7D1
  Gene Name: MAP7 domain containing 1
  ENSP ID: ENSP00000390091
MSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSR

SEQ ID NO: 49253 - protein, 140 aa, Homo sapiens
  Payload ID: 9855
  Gene Symbol: MAP7D1
  Gene Name: MAP7 domain containing 1
  ENSP ID: ENSP00000435126
MSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERR

SEQ ID NO: 49254 - protein, 248 aa, Homo sapiens
  Payload ID: 9855
  Gene Symbol: MAP7D1
  Gene Name: MAP7 domain containing 1
  ENSP ID: ENSP00000437046
  MOD_RES (1)..(1): Any amino acid
XDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTAPAPPVTPSKPMAGTTDREEATRLLAEKRRQAREQREREEQERRLQAERDKRMREEQLAREAEARAEREAEARRREEQEAREKAQAEQEEQERLQK

SEQ ID NO: 49255 - protein, 773 aa, Homo sapiens
  Payload ID: 9856
  Gene Symbol: MAP7D2
  Gene Name: MAP7 domain containing 2
  Uniprot ID: Q96T17
  ENSP ID: ENSP00000368964
MERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDACDKLSTSTMSLPKPTEPPMNKRLSSSTVAISYSPDRAHHMHLSPMEAILVSRLLTPTQSSLARSRASVMLSGQANDSVFHVCPRLAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVSPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 49256 - protein, 732 aa, Homo sapiens
  Payload ID: 9856
  Gene Symbol: MAP7D2
  Gene Name: MAP7 domain containing 2
  Uniprot ID: Q96T17
  ENSP ID: ENSP00000368972
MERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDACDKLSTSTMSLPKPTEPPMNKRLSSSTVAISYSPDRVFHVCPRLAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVSPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 49257 - protein, 687 aa, Homo sapiens
  Payload ID: 9856
  Gene Symbol: MAP7D2
  Gene Name: MAP7 domain containing 2
  Uniprot ID: Q96T17
  ENSP ID: ENSP00000388239
MERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVSPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 49258 - protein, 680 aa, Homo sapiens
  Payload ID: 9856
  Gene Symbol: MAP7D2
  Gene Name: MAP7 domain containing 2
  Uniprot ID: Q96T17
  ENSP ID: ENSP00000413301
MEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDACDKLSTSTMSLPKPTEPPMNKRLSSSTVAISYSPDRAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVSPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 49259 - protein, 876 aa, Homo sapiens
  Payload ID: 9857
  Gene Symbol: MAP7D3
  Gene Name: MAP7 domain containing 3
  Uniprot ID: Q8IWC1
  ENSP ID: ENSP00000318086
MMADGAAAGAGGSPSLRELRARMVAAANEIAKERRKQDVVNRVATHSSNIRSTFKPVIDGSMLKNDIKQRLARERREEKRRQQDANKETQLLEKERKTKLQYEKQMEERQRKLKERKEKEEQRRIAAEEKRHQKDEAQKEKFTAILYRTLERRRLADDYQQKRWSWGGSAMANSESKTANKRSASTEKLEQGTSALIRQMPLSSAGLQNSVAKRKTDKERSSSLNRRDSNLHSSTDKEQAERKPRVTGVTNYVMQYVTVPLRKCTSDELRAVMFPMSTMKIPPQTKVEESPLEKVETPPKASVDAPPQVNVEVFCNTSMEASPKAGVGMAPEVSTDSFPVVSVDVSPVVSTYDSEMSMDASPELSIEALPKVDLETVPKVSIVASPEASLEAPPEVSLEALPEVSVEAAPEGSLEAPPKGSAEVAPKESVKGSPKESMEASPEAMVKASPKTSLEASMEASPKAKARDAPKKSEMDKQALIPIAKKRLSSYTECYKWSSSPENACGLPSPISTNRQIQKNCPPSPLPLISKQSPQTSFPYKIMPIQHTLSVQSASSTVKKKKETVSKTTNRCEALSQRHMIYEESGNKSTAGIMNAEAATKILTELRRLAREQREKEEEERQREEMQQRVIKKSKDMAKEAVGGQAEDHLKLKDGQQQNETKKKKGWLDQEDQEAPLQKGDAKIKAQEEADKRKKEHERIMLQNLQERLERKKRIEEIMKRTRKTDVNASKVTETSSHDIYEEAEADNEESDKDSLNEMFPSAILNGTGSPTKFKMPFNNAKKMTHKLVFLEDGTSQVRKEPKTYFNGDLKNFRQKSMKDTSIQEVVSRPSSKRMTSHTTKTRKADETNTTSRSSAQTKSEGFHDILPKSSDTFRQ

SEQ ID NO: 49260 - protein, 802 aa, Homo sapiens
  Payload ID: 9857
  Gene Symbol: MAP7D3
  Gene Name: MAP7 domain containing 3
  ENSP ID: ENSP00000359694
MMADGAAAGAGGSPSLRELRARMVAAANEIAKERRKQDVVNRVATHSSNIRSTFKPVIDGSMLKNDIKQRLARERREEKRRQQDANKETQLLEKERKTKLQYEKQMEERQRKLKERKEKEEQRRIAAEEKRHQKDEAQKEKFTAILYRTLERRRLADDYQQKRWSWGGSAMANSESKTANKRSASTEKLEQGTSALIRQMPLSSAGLQNSVAKRKTDKERSSSLNRRDSNLHSSTDKEQAERKPRVEESPLEKVETPPKASVDAPPQVNVEVFCNTSMEASPKAGVGMAPEVSTDSFPVVSVDVSPVVSTYDSEMSMDASPELSIEALPKVDLETVPKVSIVASPEASLEAPPEVSLEALPEVSVEAAPEGSLEAPPKGSAEVAPKESVKGSPKESMEASPEAMVKASPKTSLEASMEASPKAKARDAPKKSEMDKQALIPIAKKRLSSYTECYKWSSSPENACGLPSPISTNRQIQKNCPPSPLPLISKQSPQTSFPYKIMPIQHTLSVQSASSTVKKKKETVSKTTNRCEALSQRHMIYEESGNKSTAGIMNAEAATKILTELRRLAREQREKEEEERQREEMQQRVIKKSKDMAKEAVGGQAEDHLKLKDGQQQNETKKKKGWLDQEDQEAPLQKGDAKIKAQEEADKRKKEHERIMLQNLQERLERKKRIEEIMKRTRKTDVNASKVTETSSHDIYEEAEADNEESDKDSLNEMFPSAILNGTGSPTKFKMPFNNAKKMTHKLVFLEDGTSQVRKEPKTYFNGDLKNFRQKSMKDTSIQEVVSRPSSKRMTSHTTKTR

SEQ ID NO: 49261 - protein, 841 aa, Homo sapiens
  Payload ID: 9857
  Gene Symbol: MAP7D3
  Gene Name: MAP7 domain containing 3
  Uniprot ID: Q8IWC1
  ENSP ID: ENSP00000359695
MMADGAAAGAGGSPSLRELRARMVAAANEIAKERRKQDVVNRVATHSSNIRSTFKPVIDGSMLKNDIKQRLARERREEKRRQQDANKETQLLEKERKTKLQYEKQMEERQRKLKERKEKEEQRRIAAEEKRHQKDEAQKEKFTAILYRTLERRRLADDYQQKRWSWGGSAMANSESKTGKTDKERSSSLNRRDSNLHSSTDKEQAERKPRVTGVTNYVMQYVTVPLRKCTSDELRAVMFPMSTMKIPPQTKVEESPLEKVETPPKASVDAPPQVNVEVFCNTSMEASPKAGVGMAPEVSTDSFPVVSVDVSPVVSTYDSEMSMDASPELSIEALPKVDLETVPKVSIVASPEASLEAPPEVSLEALPEVSVEAAPEGSLEAPPKGSAEVAPKESVKGSPKESMEASPEAMVKASPKTSLEASMEASPKAKARDAPKKSEMDKQALIPIAKKRLSSYTECYKWSSSPENACGLPSPISTNRQIQKNCPPSPLPLISKQSPQTSFPYKIMPIQHTLSVQSASSTVKKKKETVSKTTNRCEALSQRHMIYEESGNKSTAGIMNAEAATKILTELRRLAREQREKEEEERQREEMQQRVIKKSKDMAKEAVGGQAEDHLKLKDGQQQNETKKKKGWLDQEDQEAPLQKGDAKIKAQEEADKRKKEHERIMLQNLQERLERKKRIEEIMKRTRKTDVNASKVTETSSHDIYEEAEADNEESDKDSLNEMFPSAILNGTGSPTKFKMPFNNAKKMTHKLVFLEDGTSQVRKEPKTYFNGDLKNFRQKSMKDTSIQEVVSRPSSKRMTSHTTKTRKADETNTTSRSSAQTKSEGFHDILPKSSDTFRQ

SEQ ID NO: 49262 - protein, 858 aa, Homo sapiens
  Payload ID: 9857
  Gene Symbol: MAP7D3
  Gene Name: MAP7 domain containing 3
  Uniprot ID: Q8IWC1
  ENSP ID: ENSP00000359697
MTSPRVAAANEIAKERRKQDVVNRVATHSSNIRSTFKPVIDGSMLKNDIKQRLARERREEKRRQQDANKETQLLEKERKTKLQYEKQMEERQRKLKERKEKEEQRRIAAEEKRHQKDEAQKEKFTAILYRTLERRRLADDYQQKRWSWGGSAMANSESKTANKRSASTEKLEQGTSALIRQMPLSSAGLQNSVAKRKTDKERSSSLNRRDSNLHSSTDKEQAERKPRVTGVTNYVMQYVTVPLRKCTSDELRAVMFPMSTMKIPPQTKVEESPLEKVETPPKASVDAPPQVNVEVFCNTSMEASPKAGVGMAPEVSTDSFPVVSVDVSPVVSTYDSEMSMDASPELSIEALPKVDLETVPKVSIVASPEASLEAPPEVSLEALPEVSVEAAPEGSLEAPPKGSAEVAPKESVKGSPKESMEASPEAMVKASPKTSLEASMEASPKAKARDAPKKSEMDKQALIPIAKKRLSSYTECYKWSSSPENACGLPSPISTNRQIQKNCPPSPLPLISKQSPQTSFPYKIMPIQHTLSVQSASSTVKKKKETVSKTTNRCEALSQRHMIYEESGNKSTAGIMNAEAATKILTELRRLAREQREKEEEERQREEMQQRVIKKSKDMAKEAVGGQAEDHLKLKDGQQQNETKKKKGWLDQEDQEAPLQKGDAKIKAQEEADKRKKEHERIMLQNLQERLERKKRIEEIMKRTRKTDVNASKVTETSSHDIYEEAEADNEESDKDSLNEMFPSAILNGTGSPTKFKMPFNNAKKMTHKLVFLEDGTSQVRKEPKTYFNGDLKNFRQKSMKDTSIQEVVSRPSSKRMTSHTTKTRKADETNTTSRSSAQTKSEGFHDILPKSSDTFRQ

SEQ ID NO: 49263 - protein, 1608 aa, Homo sapiens
  Payload ID: 9858
  Gene Symbol: MADD
  Gene Name: MAP-kinase activating death domain
  Uniprot ID: Q8WXG6
  ENSP ID: ENSP00000304505
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 49264 - protein, 1647 aa, Homo sapiens
  Payload ID: 9858
  Gene Symbol: MADD
  Gene Name: MAP-kinase activating death domain
  Uniprot ID: Q8WXG6
  ENSP ID: ENSP00000310933
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIELWNKHQEVKKQKALEKQRPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 49265 - protein, 1588 aa, Homo sapiens
  Payload ID: 9858
  Gene Symbol: MADD
  Gene Name: MAP-kinase activating death domain
  ENSP ID: ENSP00000343902
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 49266 - protein, 1581 aa, Homo sapiens
  Payload ID: 9858
  Gene Symbol: MADD
  Gene Name: MAP-kinase activating death domain
  Uniprot ID: Q8WXG6
  ENSP ID: ENSP00000378745
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIELWNKHQEVKKQKALEKQRPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQFLKLKKW

SEQ ID NO: 49267 - protein, 1541 aa, Homo sapiens
  Payload ID: 9858
  Gene Symbol: MADD
  Gene Name: MAP-kinase activating death domain
  Uniprot ID: Q8WXG6
  ENSP ID: ENSP00000378753
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 49268 - protein, 1565 aa, Homo sapiens
  Payload ID: 9858
  Gene Symbol: MADD
  Gene Name: MAP-kinase activating death domain
  Uniprot ID: Q8WXG6
  ENSP ID: ENSP00000384204
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 49269 - protein, 1587 aa, Homo sapiens
  Payload ID: 9858
  Gene Symbol: MADD
  Gene Name: MAP-kinase activating death domain
  Uniprot ID: Q8WXG6
  ENSP ID: ENSP00000384287
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 49270 - protein, 1479 aa, Homo sapiens
  Payload ID: 9858
  Gene Symbol: MADD
  Gene Name: MAP-kinase activating death domain
  Uniprot ID: Q8WXG6
  ENSP ID: ENSP00000384435
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQFLKLKKW

SEQ ID NO: 49271 - protein, 439 aa, Homo sapiens
  Payload ID: 9858
  Gene Symbol: MADD
  Gene Name: MAP-kinase activating death domain
  ENSP ID: ENSP00000384483
MIRSSSQDSEVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVGASGSTRLPVVPSVRRTNVQAPSTSPASMREGPLELEGELEQLDPGKKPQGRAQ

SEQ ID NO: 49272 - protein, 1545 aa, Homo sapiens
  Payload ID: 9858
  Gene Symbol: MADD
  Gene Name: MAP-kinase activating death domain
  Uniprot ID: Q8WXG6
  ENSP ID: ENSP00000385585
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 49273 - protein, 75 aa, Homo sapiens
  Payload ID: 9858
  Gene Symbol: MADD
  Gene Name: MAP-kinase activating death domain
  ENSP ID: ENSP00000388255
MVQKKKFCPRLLDYLVIVGARHPSSDSVAQTPELLRRYPLEDHTEFPLPPDVVFFCQPEGCLSVRQRRMSLRDDT

SEQ ID NO: 49274 - protein, 154 aa, Homo sapiens
  Payload ID: 9858
  Gene Symbol: MADD
  Gene Name: MAP-kinase activating death domain
  ENSP ID: ENSP00000398167
MWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIG

SEQ ID NO: 49275 - protein, 135 aa, Homo sapiens
  Payload ID: 9858
  Gene Symbol: MADD
  Gene Name: MAP-kinase activating death domain
  ENSP ID: ENSP00000402364
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTES

SEQ ID NO: 49276 - protein, 136 aa, Homo sapiens
  Payload ID: 9858
  Gene Symbol: MADD
  Gene Name: MAP-kinase activating death domain
  ENSP ID: ENSP00000413116
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESS

SEQ ID NO: 49277 - protein, 199 aa, Homo sapiens
  Payload ID: 9858
  Gene Symbol: MADD
  Gene Name: MAP-kinase activating death domain
  ENSP ID: ENSP00000489300
  MOD_RES (1)..(1): Any amino acid
XGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQERKVFIELNHIKKCNTVRGVFVLEEFVPEIKEVVSHKYKTPMAHEICYSVLCLFSYVAAVHSSEEDLRTPPRPVSS

SEQ ID NO: 49278 - protein, 195 aa, Homo sapiens
  Payload ID: 9859
  Gene Symbol: MARCKSL1
  Gene Name: MARCKS-like 1
  Uniprot ID: P49006
  ENSP ID: ENSP00000362638
MGSQSSKAPRGDVTAEEAAGASPAKANGQENGHVKSNGDLSPKGEGESPPVNGTDEAAGATGDAIEPAPPSQGAEAKGEVPPKETPKKKKKFSFKKPFKLSGLSFKRNRKEGGGDSSASSPTEEEQEQGEIGACSDEGTAQEGKAAATPESQEPQAKGAEASAASEEEAGPQATEPSTPSGPESGPTPASAEQNE

SEQ ID NO: 49279 - protein, 189 aa, Homo sapiens
  Payload ID: 9860
  Gene Symbol: MZB1
  Gene Name: marginal zone B and B1 cell-specific protein
  Uniprot ID: Q8WU39
  ENSP ID: ENSP00000303920
MRLSLPLLLLLLGAWAIPGGLGDRAPLTATAPQLDDEEMYSAHMPAHLRCDACRAVAYQMWQNLAKAETKLHTSNSGGRRELSELVYTDVLDRSCSRNWQDYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 49280 - protein, 75 aa, Homo sapiens
  Payload ID: 9860
  Gene Symbol: MZB1
  Gene Name: marginal zone B and B1 cell-specific protein
  Uniprot ID: Q8WU39
  ENSP ID: ENSP00000415420
MRLSLPLLLLLLGAWAIPGGLGDRAPLTATAPQLDDEEMYSAHMPAHLRCDACRAVAYQRLCSYPPHLPLTEQQS

SEQ ID NO: 49281 - protein, 123 aa, Homo sapiens
  Payload ID: 9860
  Gene Symbol: MZB1
  Gene Name: marginal zone B and B1 cell-specific protein
  Uniprot ID: Q8WU39
  ENSP ID: ENSP00000423205
MRLSLPLLLLLLGAWAIPGGLGDRAPLTATAPQLDDEEMYSAHMPAHLRCDACRAVAYQSLLVPDVAKSGKGRDQTSYLKLWGAAGAERVGLHGCPGPELLPELAGLRSSRSGPSETSHRPRT

SEQ ID NO: 49282 - protein, 60 aa, Homo sapiens
  Payload ID: 9860
  Gene Symbol: MZB1
  Gene Name: marginal zone B and B1 cell-specific protein
  ENSP ID: ENSP00000424481
  MOD_RES (1)..(1): Any amino acid
XSLPLLLLLLGAWAIPGGLGDRAPLTATAPQLDDEEMYSAHMPAHLRCDACRAVAYQAHP

SEQ ID NO: 49283 - protein, 76 aa, Homo sapiens
  Payload ID: 9860
  Gene Symbol: MZB1
  Gene Name: marginal zone B and B1 cell-specific protein
  ENSP ID: ENSP00000425850
MRLSLPLLLLLLGAWAIPGGLGDRAPLTATAPQLDDEEMYSAHMPAHLRCDACRAVAYQLRSSRSGPSETSHRPRT

SEQ ID NO: 49284 - protein, 2896 aa, Homo sapiens
  Payload ID: 9861
  Gene Symbol: MKI67
  Gene Name: marker of proliferation Ki-67
  Uniprot ID: P46013
  ENSP ID: ENSP00000357642
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGRKSGNLPSKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTANRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 49285 - protein, 3256 aa, Homo sapiens
  Payload ID: 9861
  Gene Symbol: MKI67
  Gene Name: marker of proliferation Ki-67
  Uniprot ID: P46013
  ENSP ID: ENSP00000357643
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGRKSGNLPSKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTANRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 49286 - protein, 3255 aa, Homo sapiens
  Payload ID: 9861
  Gene Symbol: MKI67
  Gene Name: marker of proliferation Ki-67
  ENSP ID: ENSP00000479215
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTANRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 49287 - protein, 173 aa, Homo sapiens
  Payload ID: 9862
  Gene Symbol: MARVELD1
  Gene Name: MARVEL domain containing 1
  Uniprot ID: Q9BSK0
  ENSP ID: ENSP00000441365
MLPPPPRQPPPQARAARGAVRLQRPFLRSPLGVLRLLQLLAGAAFWITIATSKYQGPVHFALFVSVLFWLLTLGLYFLTLLGKHELVPVLGSRWLMVNVAHDVLAAALYGAATGIMSDQMQRHSYCNLKDYPLPCAYHAFLAAAVCGGVCHGLYLLSALYGCGRRCQGKQEVA

SEQ ID NO: 49288 - protein, 558 aa, Homo sapiens
  Payload ID: 9863
  Gene Symbol: MARVELD2
  Gene Name: MARVEL domain containing 2
  Uniprot ID: Q8N4S9
  ENSP ID: ENSP00000323264
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 49289 - protein, 546 aa, Homo sapiens
  Payload ID: 9863
  Gene Symbol: MARVELD2
  Gene Name: MARVEL domain containing 2
  Uniprot ID: Q8N4S9
  ENSP ID: ENSP00000396244
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQECEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 49290 - protein, 442 aa, Homo sapiens
  Payload ID: 9863
  Gene Symbol: MARVELD2
  Gene Name: MARVEL domain containing 2
  ENSP ID: ENSP00000398922
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSIALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 49291 - protein, 442 aa, Homo sapiens; identical to SEQ ID NO: 49290
  Payload ID: 9863
  Gene Symbol: MARVELD2
  Gene Name: MARVEL domain containing 2
  ENSP ID: ENSP00000414776

SEQ ID NO: 49292 - protein, 145 aa, Homo sapiens
  Payload ID: 9863
  Gene Symbol: MARVELD2
  Gene Name: MARVEL domain containing 2
  ENSP ID: ENSP00000421902
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFS

SEQ ID NO: 49293 - protein, 516 aa, Homo sapiens
  Payload ID: 9863
  Gene Symbol: MARVELD2
  Gene Name: MARVEL domain containing 2
  ENSP ID: ENSP00000423490
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKK

SEQ ID NO: 49294 - protein, 442 aa, Homo sapiens
  Payload ID: 9863
  Gene Symbol: MARVELD2
  Gene Name: MARVEL domain containing 2
  ENSP ID: ENSP00000477520
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSIALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 49295 - protein, 546 aa, Homo sapiens
  Payload ID: 9863
  Gene Symbol: MARVELD2
  Gene Name: MARVEL domain containing 2
  Uniprot ID: Q8N4S9
  ENSP ID: ENSP00000480044
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQECEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 49296 - protein, 558 aa, Homo sapiens
  Payload ID: 9863
  Gene Symbol: MARVELD2
  Gene Name: MARVEL domain containing 2
  Uniprot ID: Q8N4S9
  ENSP ID: ENSP00000480068
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 49297 - protein, 145 aa, Homo sapiens
  Payload ID: 9863
  Gene Symbol: MARVELD2
  Gene Name: MARVEL domain containing 2
  ENSP ID: ENSP00000480310
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFS

SEQ ID NO: 49298 - protein, 516 aa, Homo sapiens
  Payload ID: 9863
  Gene Symbol: MARVELD2
  Gene Name: MARVEL domain containing 2
  ENSP ID: ENSP00000480479
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKK

SEQ ID NO: 49299 - protein, 442 aa, Homo sapiens; identical to SEQ ID NO: 49294
  Payload ID: 9863
  Gene Symbol: MARVELD2
  Gene Name: MARVEL domain containing 2
  ENSP ID: ENSP00000484889

SEQ ID NO: 49300 - protein, 401 aa, Homo sapiens
  Payload ID: 9864
  Gene Symbol: MARVELD3
  Gene Name: MARVEL domain containing 3
  Uniprot ID: Q96A59
  ENSP ID: ENSP00000268485
MEDPSGAREPRARPRERDPGRRPHPDQGRTHDRPRDRPGDPRRKRSSDGNRRRDGDRDPERDQERDGNRDRNRDRERERERERDPDRGPRRDTHRDAGPRAGEHGVWEKPRQSRTRDGARGLTWDAAAPPGPAPWEAPEPPQPQRKGDPGRRRPESEPPSERYLPSTPRPGREEVEYYQSEAEGLLECHKCKYLCTGRACCQMLEVLLNLLILACSSVSYSSTGGYTGITSLGGIYYYQFGGAYSGFDGADGEKAQQLDVQFYQLKLPMVTVAMACSGALTALCCLFVAMGVLRVPWHCPLLLVTEGLLDMLIAGGYIPALYFYFHYLSAAYGSPVCKERQALYQSKGYSGFGCSFHGADIGAGIFAALGIVVFALGAVLAIKGYRKVRKLKEKPAEMFEF

SEQ ID NO: 49301 - protein, 410 aa, Homo sapiens
  Payload ID: 9864
  Gene Symbol: MARVELD3
  Gene Name: MARVEL domain containing 3
  Uniprot ID: Q96A59
  ENSP ID: ENSP00000299952
MEDPSGAREPRARPRERDPGRRPHPDQGRTHDRPRDRPGDPRRKRSSDGNRRRDGDRDPERDQERDGNRDRNRDRERERERERDPDRGPRRDTHRDAGPRAGEHGVWEKPRQSRTRDGARGLTWDAAAPPGPAPWEAPEPPQPQRKGDPGRRRPESEPPSERYLPSTPRPGREEVEYYQSEAEGLLECHKCKYLCTGRGVVQIVEVVLNGMVLICIVASYFVLAGFSASFSSGGGFGNNYYSPFEGTELEQVRQLDQQYTILRSPLIYGGVAVSLGLGVLTMGVLLQGAKSRTMLSGKWLLTEAAFSLLAAVGYCTGIGVYLHVALQINSTDTCKTRERLYARKGLTWMDCQLAGTDGAAATFACLLVIMYGASVVLALRSYREQKRYKGSREQPGSYSDAPEYLWSGTL

SEQ ID NO: 49302 - protein, 60 aa, Homo sapiens
  Payload ID: 9864
  Gene Symbol: MARVELD3
  Gene Name: MARVEL domain containing 3
  ENSP ID: ENSP00000455814
MPQMQILVHWESLLPNAGGSPELADPGLQLCVLQFHRGLHGHHQLGGHLLLSVRRGLQWL

SEQ ID NO: 49303 - protein, 148 aa, Homo sapiens
  Payload ID: 9864
  Gene Symbol: MARVELD3
  Gene Name: MARVEL domain containing 3
  Uniprot ID: Q96A59
  ENSP ID: ENSP00000455845
MEDPSGAREPRARPRERDPGRRPHPDQGRTHDRPRDRPGDPRRKRSSDGNRRRDGDRDPERDQERDGNRDRNRDRERERERERDPDRGPRRDTHRDAGPRAVNPLRRDICPRPPGLDERRWNITSQRRKDSWNATNANTCALGEVWCR

SEQ ID NO: 49304 - protein, 219 aa, Homo sapiens
  Payload ID: 9864
  Gene Symbol: MARVELD3
  Gene Name: MARVEL domain containing 3
  ENSP ID: ENSP00000462555
MEDPSGAREPRARPRERDPGRRPHPDQGRTHDRPRDRPGDPRRKRSSDGNRRRDGDRDPERDQERDGNRDRNRDRERERERERDPDRGPRRDTHRDAGPRAGEHGVWEKPRQSRTRDGARGLTWDAAAPPGPAPWEAPEPPQPQRKGDPGRRRPESEPPSERYLPSTPRPGREEVEYYQSEAEGLLECHKCKYLCTGRGEPFCRLFDHLLSLVVLEGMV

SEQ ID NO: 49305 - protein, 378 aa, Homo sapiens
  Payload ID: 9865
  Gene Symbol: MAS1L
  Gene Name: MAS1 proto-oncogene like, G protein-coupled receptor
  Uniprot ID: P35410
  ENSP ID: ENSP00000366331
MVWGKICWFSQRAGWTVFAESQISLSCSLCLHSGDQEAQNPNLVSQLCGVFLQNETNETIHMQMSMAVGQQALPLNIIAPKAVLVSLCGVLLNGTVFWLLCCGATNPYMVYILHLVAADVIYLCCSAVGFLQVTLLTYHGVVFFIPDFLAILSPFSFEVCLCLLVAISTERCVCVLFPIWYRCHRPKYTSNVVCTLIWGLPFCINIVKSLFLTYWKHVKACVIFLKLSGLFHAILSLVMCVSSLTLLIRFLCCSQQQKATRVYAVVQISAPMFLLWALPLSVAPLITDFKMFVTTSYLISLFLIINSSANPIIYFFVGSLRKKRLKESLRVILQRALADKPEVGRNKKAAGIDPMEQPHSTQHVENLLPREHRVDVET

SEQ ID NO: 49306 - protein, 378 aa, Homo sapiens; identical to SEQ ID NO: 49305
  Payload ID: 9865
  Gene Symbol: MAS1L
  Gene Name: MAS1 proto-oncogene like, G protein-coupled receptor
  Uniprot ID: P35410
  ENSP ID: ENSP00000373041

SEQ ID NO: 49307 - protein, 378 aa, Homo sapiens; identical to SEQ ID NO: 49305
  Payload ID: 9865
  Gene Symbol: MAS1L
  Gene Name: MAS1 proto-oncogene like, G protein-coupled receptor
  Uniprot ID: P35410
  ENSP ID: ENSP00000373139

SEQ ID NO: 49308 - protein, 378 aa, Homo sapiens; identical to SEQ ID NO: 49305
  Payload ID: 9865
  Gene Symbol: MAS1L
  Gene Name: MAS1 proto-oncogene like, G protein-coupled receptor
  Uniprot ID: P35410
  ENSP ID: ENSP00000392071

SEQ ID NO: 49309 - protein, 378 aa, Homo sapiens; identical to SEQ ID NO: 49305
  Payload ID: 9865
  Gene Symbol: MAS1L
  Gene Name: MAS1 proto-oncogene like, G protein-coupled receptor
  Uniprot ID: P35410
  ENSP ID: ENSP00000399042

SEQ ID NO: 49310 - protein, 378 aa, Homo sapiens; identical to SEQ ID NO: 49305
  Payload ID: 9865
  Gene Symbol: MAS1L
  Gene Name: MAS1 proto-oncogene like, G protein-coupled receptor
  Uniprot ID: P35410
  ENSP ID: ENSP00000405030

SEQ ID NO: 49311 - protein, 378 aa, Homo sapiens; identical to SEQ ID NO: 49305
  Payload ID: 9865
  Gene Symbol: MAS1L
  Gene Name: MAS1 proto-oncogene like, G protein-coupled receptor
  Uniprot ID: P35410
  ENSP ID: ENSP00000405164

SEQ ID NO: 49312 - protein, 378 aa, Homo sapiens; identical to SEQ ID NO: 49305
  Payload ID: 9865
  Gene Symbol: MAS1L
  Gene Name: MAS1 proto-oncogene like, G protein-coupled receptor
  Uniprot ID: P35410
  ENSP ID: ENSP00000410649

SEQ ID NO: 49313 - protein, 325 aa, Homo sapiens
  Payload ID: 9866
  Gene Symbol: MAS1
  Gene Name: MAS1 proto-oncogene, G protein-coupled receptor
  Uniprot ID: P04201
  ENSP ID: ENSP00000252660
MDGSNVTSFVVEEPTNISTGRNASVGNAHRQIPIVHWVIMSISPVGFVENGILLWFLCFRMRRNPFTVYITHLSIADISLLFCIFILSIDYALDYELSSGHYYTIVTLSVTFLFGYNTGLYLLTAISVERCLSVLYPIWYRCHRPKYQSALVCALLWALSCLVTTMEYVMCIDREEESHSRNDCRAVIIFIAILSFLVFTPLMLVSSTILVVKIRKNTWASHSSKLYIVIMVTIIIFLIFAMPMRLLYLLYYEYWSTFGNLHHISLLFSTINSSANPFIYFFVGSSKKKRFKESLKVVLTRAFKDEMQPRRQKDNCNTVTVETVV

SEQ ID NO: 49314 - protein, 321 aa, Homo sapiens
  Payload ID: 9867
  Gene Symbol: MRGPRD
  Gene Name: MAS-related GPR, member D
  Uniprot ID: Q8TDS7
  ENSP ID: ENSP00000310631
MNQTLNSSGTVESALNYSRGSTVHTAYLVLSSLAMFTCLCGMAGNSMVIWLLGFRMHRNPFCIYILNLAAADLLFLFSMASTLSLETQPLVNTTDKVHELMKRLMYFAYTVGLSLLTAISTQRCLSVLFPIWFKCHRPRHLSAWVCGLLWTLCLLMNGLTSSFCSKFLKFNEDRCFRVDMVQAALIMGVLTPVMTLSSLTLFVWVRRSSQQWRRQPTRLFVVVLASVLVFLICSLPLSIYWFVLYWLSLPPEMQVLCFSLSRLSSSVSSSANPVIYFLVGSRRSHRLPTRSLGTVLQQALREEPELEGGETPTVGTNEMGA

SEQ ID NO: 49315 - protein, 312 aa, Homo sapiens
  Payload ID: 9868
  Gene Symbol: MRGPRE
  Gene Name: MAS-related GPR, member E
  Uniprot ID: Q86SM8
  ENSP ID: ENSP00000374482
MMEPREAGQHVGAANGAQEDVAFNLIILSLTEGLGLGGLLGNGAVLWLLSSNVYRNPFAIYLLDVACADLIFLGCHMVAIVPDLLQGRLDFPGFVQTSLATLRFFCYIVGLSLLAAVSVEQCLAALFPAWYSCRRPRHLTTCVCALTWALCLLLHLLLSGACTQFFGEPSRHLCRTLWLVAAVLLALLCCTMCGASLMLLLRVERGPQRPPPRGFPGLILLTVLLFLFCGLPFGIYWLSRNLLWYIPHYFYHFSFLMAAVHCAAKPVVYFCLGSAQGRRLPLRLVLQRALGDEAELGAVRETSRRGLVDIAA

SEQ ID NO: 49316 - protein, 343 aa, Homo sapiens
  Payload ID: 9869
  Gene Symbol: MRGPRF
  Gene Name: MAS-related GPR, member F
  Uniprot ID: Q96AM1
  ENSP ID: ENSP00000309782
MAGNCSWEAHPGNRNKMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 49317 - protein, 104 aa, Homo sapiens
  Payload ID: 9869
  Gene Symbol: MRGPRF
  Gene Name: MAS-related GPR, member F
  ENSP ID: ENSP00000323414
MAGNCSWEAHPGNRNKVSATGGGPWSCPDGCGWEGQTQPSISSPIPPFLAPLSSSGPTVGSGLLWAMWPGTSSLDPPTLLSSSVRQAPGLDLKVPRCADTVVAL

SEQ ID NO: 49318 - protein, 343 aa, Homo sapiens; identical to SEQ ID NO: 49316
  Payload ID: 9869
  Gene Symbol: MRGPRF
  Gene Name: MAS-related GPR, member F
  Uniprot ID: Q96AM1
  ENSP ID: ENSP00000403660

SEQ ID NO: 49319 - protein, 289 aa, Homo sapiens
  Payload ID: 9870
  Gene Symbol: MRGPRG
  Gene Name: MAS-related GPR, member G
  Uniprot ID: Q86SM5
  ENSP ID: ENSP00000330612
MFGLFGLWRTFDSVVFYLTLIVGLGGPVGNGLVLWNLGFRIKKGPFSIYLLHLAAADFLFLSCRVGFSVAQAALGAQDTLYFVLTFLWFAVGLWLLAAFSVERCLSDLFPACYQGCRPRHASAVLCALVWTPTLPAVPLPANACGLLRNSACPLVCPRYHVASVTWFLVLARVAWTAGVVLFVWVTCCSTRPRPRLYGIVLGALLLLFFCGLPSVFYWSLQPLLNFLLPVFSPLATLLACVNSSSKPLIYSGLGRQPGKREPLRSVLRRALGEGAELGARGQSLPMGLL

SEQ ID NO: 49320 - protein, 322 aa, Homo sapiens
  Payload ID: 9871
  Gene Symbol: MRGPRX1
  Gene Name: MAS-related GPR, member X1
  Uniprot ID: Q96LB2
  ENSP ID: ENSP00000305766
MDPTISTLDTELTPINGTEETLCYKQTLSLTVLTCIVSLVGLTGNAVVLWLLGCRMRRNAFSIYILNLAAADFLFLSGRLIYSLLSFISIPHTISKILYPVMMFSYFAGLSFLSAVSTERCLSVLWPIWYRCHRPTHLSAVVCVLLWALSLLRSILEWMLCGFLFSGADSAWCQTSDFITVAWLIFLCVVLCGSSLVLLIRILCGSRKIPLTRLYVTILLTVLVFLLCGLPFGIQFFLFLWIHVDREVLFCHVHLVSIFLSALNSSANPIIYFFVGSFRQRQNRQNLKLVLQRALQDASEVDEGGGQLPEEILELSGSRLEQ

SEQ ID NO: 49321 - protein, 330 aa, Homo sapiens
  Payload ID: 9872
  Gene Symbol: MRGPRX2
  Gene Name: MAS-related GPR, member X2
  Uniprot ID: Q96LB1
  ENSP ID: ENSP00000333800
MDPTTPAWGTESTTVNGNDQALLLLCGKETLIPVFLILFIALVGLVGNGFVLWLLGFRMRRNAFSVYVLSLAGADFLFLCFQIINCLVYLSNFFCSISINFPSFFTTVMTCAYLAGLSMLSTVSTERCLSVLWPIWYRCRRPRHLSAVVCVLLWALSLLLSILEGKFCGFLFSDGDSGWCQTFDFITAAWLIFLFMVLCGSSLALLVRILCGSRGLPLTRLYLTILLTVLVFLLCGLPFGIQWFLILWIWKDSDVLFCHIHPVSVVLSSLNSSANPIIYFFVGSFRKQWRLQQPILKLALQRALQDIAEVDHSEGCFRQGTPEMSRSSLV

SEQ ID NO: 49322 - protein, 322 aa, Homo sapiens
  Payload ID: 9873
  Gene Symbol: MRGPRX3
  Gene Name: MAS-related GPR, member X3
  Uniprot ID: Q96LB0
  ENSP ID: ENSP00000379571
MDSTIPVLGTELTPINGREETPCYKQTLSFTGLTCIVSLVALTGNAVVLWLLGCRMRRNAVSIYILNLVAADFLFLSGHIICSPLRLINIRHPISKILSPVMTFPYFIGLSMLSAISTERCLSILWPIWYHCRRPRYLSSVMCVLLWALSLLRSILEWMFCDFLFSGANSVWCETSDFITIAWLVFLCVVLCGSSLVLLVRILCGSRKMPLTRLYVTILLTVLVFLLCGLPFGIQWALFSRIHLDWKVLFCHVHLVSIFLSALNSSANPIIYFFVGSFRQRQNRQNLKLVLQRALQDTPEVDEGGGWLPQETLELSGSRLEQ

SEQ ID NO: 49323 - protein, 246 aa, Homo sapiens
  Payload ID: 9873
  Gene Symbol: MRGPRX3
  Gene Name: MAS-related GPR, member X3
  ENSP ID: ENSP00000436242
MDSTIPVLGTELTPINGREETPCYKQTLSFTGLTCIVSLVALTGNAVVLWLLGCRMRRNAVSIYILNLVAADFLFLSGHIICSPLRLINIRHPISKILSPVMTFPYFIGLSMLSAISTERCLSILWPIWYHCRRPRYLSSVMCVLLWALSLLRSILEWMFCDFLFSGANSVWCETSDFITIAWLVFLCVVLCGSSLVLLVRILCGSRKMPLTRLYVTILLTVLVFLLCGLPFGIQWALFSRIHLDW

SEQ ID NO: 49324 - protein, 322 aa, Homo sapiens; identical to SEQ ID NO: 49322
  Payload ID: 9873
  Gene Symbol: MRGPRX3
  Gene Name: MAS-related GPR, member X3
  Uniprot ID: Q96LB0
  ENSP ID: ENSP00000481943

SEQ ID NO: 49325 - protein, 322 aa, Homo sapiens
  Payload ID: 9874
  Gene Symbol: MRGPRX4
  Gene Name: MAS-related GPR, member X4
  Uniprot ID: Q96LA9
  ENSP ID: ENSP00000314042
MDPTVPVFGTKLTPINGREETPCYNQTLSFTVLTCIISLVGLTGNAVVLWLLGYRMRRNAVSIYILNLAAADFLFLSFQIIRLPLRLINISHLIRKILVSVMTFPYFTGLSMLSAISTERCLSVLWPIWYRCRRPTHLSAVVCVLLWGLSLLFSMLEWRFCDFLFSGADSSWCETSDFIPVAWLIFLCVVLCVSSLVLLVRILCGSRKMPLTRLYVTILLTVLVFLLCGLPFGILGALIYRMHLNLEVLYCHVYLVCMSLSSLNSSANPIIYFFVGSFRQRQNRQNLKLVLQRALQDKPEVDKGEGQLPEESLELSGSRLGP

SEQ ID NO: 49326 - protein, 322 aa, Homo sapiens
  Payload ID: 9874
  Gene Symbol: MRGPRX4
  Gene Name: MAS-related GPR, member X4
  ENSP ID: ENSP00000482346
MDPTVPVFGTKLTPINGREETPCYNQTLSFTVLTCIISLVGLTGNAVVLWLLGYRMRRNAVSIYILNLAAADFLFLSFQIIRLPLRLINISHLIRKILVSVMTFPYFTGLSMLSAISTERCLSVLWPIWYRCRRPTHLSAVVCVLLWGLSLLFSMLEWRFCDFLFSGADSSWCETSDFIPVAWLIFLCVVLCVSSLVLLVRILCGSRKMPLTRLYVTILLTVLVFLLCGLPFGILGALIYRMHLNLEVLYCHVQPVSDVLSSLNSSANPIIYFFMGSFRQRQNWQNLKLVLQKALQDTPEVDEGGGRLPQETLEMSGSRLEQ

SEQ ID NO: 49327 - protein, 89 aa, Homo sapiens
  Payload ID: 9875
  Gene Symbol: MILR1
  Gene Name: mast cell immunoglobulin-like receptor 1
  ENSP ID: ENSP00000474420
  MOD_RES (1)..(1): Any amino acid
XKAMRNNVPRDRGDTAMEVGIYANILEKQAKEESVPEVGSRPCVSTAQDEAKHSQELQYATPVFQEVAPREQEACDSYKSGYVYSELNF

SEQ ID NO: 49328 - protein, 253 aa, Homo sapiens
  Payload ID: 9875
  Gene Symbol: MILR1
  Gene Name: mast cell immunoglobulin-like receptor 1
  Uniprot ID: Q7Z6M3
  ENSP ID: ENSP00000477504
MWSHLNRLLFWSIFSSVTCRKAVLDCEAMKTNDPVTSPVLNIMVIQTETDRHITLHCLSVNGSLPINYTFFENHVAISPAISKYDREPAEFNLTKKNPGEEEEYRCEAKNRLPNYATYSHPVTMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELNF

SEQ ID NO: 49329 - protein, 186 aa, Homo sapiens
  Payload ID: 9875
  Gene Symbol: MILR1
  Gene Name: mast cell immunoglobulin-like receptor 1
  ENSP ID: ENSP00000479516
MWSHLNRLLFWSIFSSVTCRKAVLDCEAMKTNEFPSPCLDSKTKVVMKGQNVSMFCSHKNKSLQITYSLFRRKTHLGTQDGKGEPAIFNLSITEAHESGPYKCKAQVTSCSKYSRDFSFTIVDPVTSPVLNIMVIQTETDRHITLHCLSVNGSLPINYTFFENHVAISPAISKYDREPAEFNLTKK

SEQ ID NO: 49330 - protein, 343 aa, Homo sapiens
  Payload ID: 9875
  Gene Symbol: MILR1
  Gene Name: mast cell immunoglobulin-like receptor 1
  Uniprot ID: Q7Z6M3
  ENSP ID: ENSP00000480749
MWSHLNRLLFWSIFSSVTCRKAVLDCEAMKTNEFPSPCLDSKTKVVMKGQNVSMFCSHKNKSLQITYSLFRRKTHLGTQDGKGEPAIFNLSITEAHESGPYKCKAQVTSCSKYSRDFSFTIVDPVTSPVLNIMVIQTETDRHITLHCLSVNGSLPINYTFFENHVAISPAISKYDREPAEFNLTKKNPGEEEEYRCEAKNRLPNYATYSHPVTMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELNF

SEQ ID NO: 49331 - protein, 248 aa, Homo sapiens
  Payload ID: 9875
  Gene Symbol: MILR1
  Gene Name: mast cell immunoglobulin-like receptor 1
  Uniprot ID: Q7Z6M3
  ENSP ID: ENSP00000481318
MWSHLNRLLFWSIFSSVTCRKAVLDCEAMKTNEFPSPCLDSKTKVVMKGQNVSMFCSHKNKSLQITYSLFRRKTHLGTQDGKGEPAIFNLSITEAHESGPYKCKAQVTSCSKYSRDFSFTIVGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELNF

SEQ ID NO: 49332 - protein, 343 aa, Homo sapiens; identical to SEQ ID NO: 49330
  Payload ID: 9875
  Gene Symbol: MILR1
  Gene Name: mast cell immunoglobulin-like receptor 1
  Uniprot ID: Q7Z6M3
  ENSP ID: ENSP00000482801

SEQ ID NO: 49333 - protein, 89 aa, Homo sapiens; identical to SEQ ID NO: 49327
  Payload ID: 9875
  Gene Symbol: MILR1
  Gene Name: mast cell immunoglobulin-like receptor 1
  ENSP ID: ENSP00000484073
  MOD_RES (1)..(1): Any amino acid

SEQ ID NO: 49334 - protein, 187 aa, Homo sapiens
  Payload ID: 9876
  Gene Symbol: MCEMP1
  Gene Name: mast cell-expressed membrane protein 1
  Uniprot ID: Q8IX19
  ENSP ID: ENSP00000329920
MEVEEIYKHQEVKMQAPAFRDKKQGVSAKNQGAHDPDYENITLAFKNQDHAKGGHSRPTSQVPAQCRPPSDSTQVPCWLYRAILSLYILLALAFVLCIILSAFIMVKNAEMSKELLGFKRELWNVSNSVQACEERQKRGWDSVQQSITMVRSKIDRLETTLAGIKNIDTKVQKILEVLQKMPQSSPQ

SEQ ID NO: 49335 - protein, 144 aa, Homo sapiens
  Payload ID: 9876
  Gene Symbol: MCEMP1
  Gene Name: mast cell-expressed membrane protein 1
  ENSP ID: ENSP00000471413
MQAPAFRDKKQGVSAKNQVPAQCRPPSDSTQVPCWLYRAILSLYILLALAFVLCIILSAFIMVKNAEMSKELLGFKRELWNVSNSVQACEERQKRGWDSVQQSITMVRSKIDRLETTLAGIKNIDTKVQKILEVLQKMPQSSPQ

SEQ ID NO: 49336 - protein, 774 aa, Homo sapiens
  Payload ID: 9877
  Gene Symbol: MAMLD1
  Gene Name: mastermind-like domain containing 1
  Uniprot ID: Q13495
  ENSP ID: ENSP00000262858
MDDWKSRLVIKSMLPHFAMVGNRQEPRKLQESGKKPSWMEEEDLSFLYKSSPGRKHQGTVKRRQEEDHFQFPDMADGGYPNKIKRPCLEDVTLAMGPGAHPSTACAELQVPPLTINPSPAAMGVAGQSLLLENNPMNGNIMGSPFVVPQTTEVGLKGPTVPYYEKINSVPAVDQELQELLEELTKIQDPSPNELDLEKILGTKPEEPLVLDHPQATLSTTPKPSVQMSHLESLASSKEFASSCSQVTGMSLQIPSSSTGISYSIPSTSKQIVSPSSSMAQSKSQVQAMLPVALPPLPVPQWHHAHQLKALAASKQGSATKQQGPTPSWSGLPPPGLSPPYRPVPSPHPPPLPLPPPPPPFSPQSLMVSCMSSNTLSGSTLRGSPNALLSSMTSSSNAALGPAMPYAPEKLPSPALTQQPQFGPQSSILANLMSSTIKTPQGHLMSALPASNPGPSPPYRPEKLSSPGLPQQSFTPQCSLIRSLTPTSNLLSQQQQQQQQQQQANVIFKPISSNSSKTLSMIMQQGMASSSPGATEPFTFGNTKPLSHFVSEPGPQKMPSMPTTSRQPSLLHYLQQPTPTQASSATASSTATATLQLQQQQQQQQQQPDHSSFLLQQMMQQPQRFQRSVASDSMPALPRQGCCHLFAWTSAASSVKPQHQHGNSFTSRQDPQPGDVSPSNITHVDKACKLGEARHPQVSLGRQPPSCQALGSESFLPGSSFAHELARVTSSYSTSEAAPWGSWDPKAWRQVPAPLLPSCDATARGTEIRSYGNDP

SEQ ID NO: 49337 - protein, 136 aa, Homo sapiens
  Payload ID: 9877
  Gene Symbol: MAMLD1
  Gene Name: mastermind-like domain containing 1
  ENSP ID: ENSP00000351765
MDDWKSRLVIKSMLPHFAMVGNRQEPRKLQESGKKPSWMEEEDLSFLYKSSPGRKHQGTVKRRQEEDHFQFPDMADGGYPNKIKRPCLEDVTLAMGPGAHPSTACAELQVPPLTINPSPAAMGVAGQSLLLENNPM

SEQ ID NO: 49338 - protein, 774 aa, Homo sapiens; identical to SEQ ID NO: 49336
  Payload ID: 9877
  Gene Symbol: MAMLD1
  Gene Name: mastermind-like domain containing 1
  Uniprot ID: Q13495
  ENSP ID: ENSP00000359428

SEQ ID NO: 49339 - protein, 749 aa, Homo sapiens
  Payload ID: 9877
  Gene Symbol: MAMLD1
  Gene Name: mastermind-like domain containing 1
  Uniprot ID: Q13495
  ENSP ID: ENSP00000397438
MDDWKSRLVIKSMLPHFAMVGNRQEPRKLQESGTVKRRQEEDHFQFPDMADGGYPNKIKRPCLEDVTLAMGPGAHPSTACAELQVPPLTINPSPAAMGVAGQSLLLENNPMNGNIMGSPFVVPQTTEVGLKGPTVPYYEKINSVPAVDQELQELLEELTKIQDPSPNELDLEKILGTKPEEPLVLDHPQATLSTTPKPSVQMSHLESLASSKEFASSCSQVTGMSLQIPSSSTGISYSIPSTSKQIVSPSSSMAQSKSQVQAMLPVALPPLPVPQWHHAHQLKALAASKQGSATKQQGPTPSWSGLPPPGLSPPYRPVPSPHPPPLPLPPPPPPFSPQSLMVSCMSSNTLSGSTLRGSPNALLSSMTSSSNAALGPAMPYAPEKLPSPALTQQPQFGPQSSILANLMSSTIKTPQGHLMSALPASNPGPSPPYRPEKLSSPGLPQQSFTPQCSLIRSLTPTSNLLSQQQQQQQQQQQANVIFKPISSNSSKTLSMIMQQGMASSSPGATEPFTFGNTKPLSHFVSEPGPQKMPSMPTTSRQPSLLHYLQQPTPTQASSATASSTATATLQLQQQQQQQQQQPDHSSFLLQQMMQQPQRFQRSVASDSMPALPRQGCCHLFAWTSAASSVKPQHQHGNSFTSRQDPQPGDVSPSNITHVDKACKLGEARHPQVSLGRQPPSCQALGSESFLPGSSFAHELARVTSSYSTSEAAPWGSWDPKAWRQVPAPLLPSCDATARGTEIRSYGNDP

SEQ ID NO: 49340 - protein, 998 aa, Homo sapiens
  Payload ID: 9877
  Gene Symbol: MAMLD1
  Gene Name: mastermind-like domain containing 1
  Uniprot ID: Q13495
  ENSP ID: ENSP00000414517
MDDWKSRLVIKSMLPHFAMVGNRQEPRKLQESGTVKRRQEEDHFQFPDMADGGYPNKIKRPCLEDVTLAMGPGAHPSTACAELQVPPLTINPSPAAMGVAGQSLLLENNPMNGNIMGSPFVVPQTTEVGLKGPTVPYYEKINSVPAVDQELQELLEELTKIQDPSPNELDLEKILGTKPEEPLVLDHPQATLSTTPKPSVQMSHLESLASSKEFASSCSQVTGMSLQIPSSSTGISYSIPSTSKQIVSPSSSMAQSKSQVQAMLPVALPPLPVPQWHHAHQLKALAASKQGSATKQQGPTPSWSGLPPPGLSPPYRPVPSPHPPPLPLPPPPPPFSPQSLMVSCMSSNTLSGSTLRGSPNALLSSMTSSSNAALGPAMPYAPEKLPSPALTQQPQFGPQSSILANLMSSTIKTPQGHLMSALPASNPGPSPPYRPEKLSSPGLPQQSFTPQCSLIRSLTPTSNLLSQQQQQQQQQQQANVIFKPISSNSSKTLSMIMQQGMASSSPGATEPFTFGNTKPLSHFVSEPGPQKMPSMPTTSRQPSLLHYLQQPTPTQASSATASSTATATLQLQQQQQQQQQQPDHSSFLLQQMMQQPQRFQRSVASDSMPALPRQQEEQRSGLMAMTPERQNAYISQQMSPFEAVQEQVTSKCSRIKASPPSSKHLMPPRTGLLQNNLSPGMIPLTRHQSCEGMGVISPTLGKRQGIFTSSPQCPILSHSGQTPLGRLDSVCQHMQSPKATPPEVPLPGFCPSSLGTQSLSPHQLRRPSVPRMPTAFNNAAWVTAAAAVTTAVSGKTPLSQVDNSVQQHSPSGQACLQRPSDWEAQVPAAMGTQVPLANNPSFSLLGSQSLRQSPVQGPVPVANTTKFLQQGMASFSPLSPIQGIEPPSYVAAAATAAAASAVAASQFPGPFDRTDIPPELPPADFLRQPQPPLNDLISSPDCNEVDFIEALLKGSCVSPDEDWVCNLRLIDDILEQHAAAQNATAQNSGQVTQDAGAL

SEQ ID NO: 49341 - protein, 1016 aa, Homo sapiens
  Payload ID: 9878
  Gene Symbol: MAML1
  Gene Name: mastermind-like transcriptional coactivator 1
  Uniprot ID: Q92585
  ENSP ID: ENSP00000292599
MVLPTCPMAEFALPRHSAVMERLRRRIELCRRHHSTCEARYEAVSPERLELERQHTFALHQRCIQAKAKRAGKHRQPPAATAPAPAAPAPRLDAADGPEHGRPATHLHDTVKRNLDSATSPQNGDQQNGYGDLFPGHKKTRREAPLGVAISSNGLPPASPLGQSDKPSGADALQSSGKHSLGLDSLNKKRLADSSLHLNGGSNPSESFPLSLNKELKQEPVEDLPCMITGTVGSISQSNLMPDLNLNEQEWKELIEELNRSVPDEDMKDLFNEDFEEKKDPESSGSATQTPLAQDINIKTEFSPAAFEQEQLGSPQVRAGSAGQTFLGPSSAPVSTDSPSLGGSQTLFHTSGQPRADNPSPNLMPASAQAQNAQRALAGVVLPSQGPGGASELSSAHQLQQIAAKQKREQMLQNPQQATPAPAPGQMSTWQQTGPSHSSLDVPYPMEKPASPSSYKQDFTNSKLLMMPSVNKSSPRPGGPYLQPSHVNLLSHQPPSNLNQNSANNQGSVLDYGNTKPLSHYKADCGQGSPGSGQSKPALMAYLPQQLSHISHEQNSLFLMKPKPGNMPFRSLVPPGQEQNPSSVPVQAQATSVGTQPPAVSVASSHNSSPYLSSQQQAAVMKQHQLLLDQQKQREQQQKHLQQQQFLQRQQHLLAEQEKQQFQRHLTRPPPQYQDPTQGSFPQQVGQFTGSSAAVPGMNTLGPSNSSCPRVFPQAGNLMPMGPGHASVSSLPTNSGQQDRGVAQFPGSQNMPQSSLYGMASGITQIVAQPPPQATNGHAHIPRQTNVGQNTSVSAAYGQNSLGSSGLSQQHNKGTLNPGLTKPPVPRVSPAMGGQNSSWQHQGMPNLSGQTPGNSNVSPFTAASSFHMQQQAHLKMSSPQFSQAVPNRPMAPMSSAAAVGSLLPPVSAQQRTSAPAPAPPPTAPQQGLPGLSPAGPELGAFSQSPASQMGGRAGLHCTQAYPVRTAGQELPFAYSGQPGGSGLSSVAGHTDLIDSLLKNRTSEEWMSDLDDLLGSQ

SEQ ID NO: 49342 - protein, 1156 aa, Homo sapiens
  Payload ID: 9879
  Gene Symbol: MAML2
  Gene Name: mastermind-like transcriptional coactivator 2
  Uniprot ID: Q8IZL2
  ENSP ID: ENSP00000434552
MGDTAPPQAPAGGLGGASGAGLLGGGSVTPRVHSAIVERLRARIAVCRQHHLSCEGRYERGRAESSDRERESTLQLLSLVQHGQGARKAGKHTKATATAATTTAPPPPPAAPPAASQAAATAAPPPPPDYHHHHQQHLLNSSNNGGSGGINGEQQPPASTPGDQRNSALIALQGSLKRKQVVNLSPANSKRPNGFVDNSFLDIKRIRVGENLSAGQGGLQINNGQSQIMSGTLPMSQAPLRKTNTLPSHTHSPGNGLFNMGLKEVKKEPGETLSCSKHMDGQMTQENIFPNRYGDDPGEQLMDPELQELFNELTNISVPPMSDLELENMINATIKQDDPFNIDLGQQSQRSTPRPSLPMEKIVIKSEYSPGLTQGPSGSPQLRPPSAGPAFSMANSALSTSSPIPSVPQSQAQPQTGSGASRALPSWQEVSHAQQLKQIAANRQQHARMQQHQQQHQPTNWSALPSSAGPSPGPFGQEKIPSPSFGQQTFSPQSSPMPGVAGGSGQSKVMANYMYKAGPSAQGGHLDVLMQQKPQDLSRSFINNPHPAMEPRQGNTKPLFHFNSDQANQQMPSVLPSQNKPSLLHYTQQQQQQQQQQQQQQQQQQQQQQQQQQQQQQQQQQSSISAQQQQQQQSSISAQQQQQQQQQQQQQQQQQQQQQQQQQQQPSSQPAQSLPSQPLLRSPLPLQQKLLLQQMQNQPIAGMGYQVSQQQRQDQHSVVGQNTGPSPSPNPCSNPNTGSGYMNSQQSLLNQQLMGKKQTLQRQIMEQKQQLLLQQQMLADAEKIAPQDQINRHLSRPPPDYKDQRRNVGNMQPTAQYSGGSSTISLNSNQALANPVSTHTILTPNSSLLSTSHGTRMPSLSTAVQNMGMYGNLPCNQPNTYSVTSGMNQLTQQRNPKQLLANQNNPMMPRPPTLGPSNNNNVATFGAGSVGNSQQLRPNLTHSMASMPPQRTSNVMITSNTTAPNWASQEGTSKQQEALTSAGVRFPTGTPAAYTPNQSLQQAVGSQQFSQRAVAPPNQLTPAVQMRPMNQMSQTLNGQTMGPLRGLNLRPNQLSTQILPNLNQSGTGLNQSRTGINQPPSLTPSNFPSPNQSSRAFQGTDHSSDLAFDFLSQQNDNMGPALNSDADFIDSLLKTEPGNDDWMKDINLDEILGNNS

SEQ ID NO: 49343 - protein, 986 aa, Homo sapiens
  Payload ID: 9879
  Gene Symbol: MAML2
  Gene Name: mastermind-like transcriptional coactivator 2
  ENSP ID: ENSP00000483371
QLQGSLKRKQVVNLSPANSKRPNGFVDNSFLDIKRIRVGENLSAGQGGLQINNGQSQIMSGTLPMSQAPLRKTNTLPSHTHSPGNGLFNMGLKEVKKEPGETLSCSKHMDGQMTQENIFPNRYGDDPGEQLMDPELQELFNELTNISVPPMSDLELENMINATIKQDDPFNIDLGQQSQRSTPRPSLPMEKIVIKSEYSPGLTQGPSGSPQLRPPSAGPAFSMANSALSTSSPIPSVPQSQAQPQTGSGASRALPSWQEVSHAQQLKQIAANRQQHARMQQHQQQHQPTNWSALPSSAGPSPGPFGQEKIPSPSFGQQTFSPQSSPMPGVAGGSGQSKVMANYMYKAGPSAQGGHLDVLMQQKPQDLSRSFINNPHPAMEPRQGNTKPLFHFNSDQANQQMPSVLPSQNKPSLLHYTQQQQQQQQQQQQQQQQQQQQQQQQQQQQQQQQQQSSISAQQQQQQQSSISAQQQQQQQQQQQQQQQQQQQQQQQQQQQPSSQPAQSLPSQPLLRSPLPLQQKLLLQQMQNQPIAGMGYQVSQQQRQDQHSVVGQNTGPSPSPNPCSNPNTGSGYMNSQQSLLNQQLMGKKQTLQRQIMEQKQQLLLQQQMLADAEKIAPQDQINRHLSRPPPDYKDQRRNVGNMQPTAQYSGGSSTISLNSNQALANPVSTHTILTPNSSLLSTSHGTRMPSLSTAVQNMGMYGNLPCNQPNTYSVTSGMNQLTQQRNPKQLLANQNNPMMPRPPTLGPSNNNNVATFGAGSVGNSQQLRPNLTHSMASMPPQRTSNVMITSNTTAPNWASQEGTSKQQEALTSAGVRFPTGTPAAYTPNQSLQQAVGSQQFSQRAVAPPNQLTPAVQMRPMNQMSQTLNGQTMGPLRGLNLRPNQLSTQILPNLNQSGTGLNQSRTGINQPPSLTPSNFPSPNQSSRAFQGTDHSSDLAFDFLSQQNDNMGPALNSDADFIDSLLKTEPGNDDWMKDINLDEILGNNS

SEQ ID NO: 49344 - protein, 276 aa, Homo sapiens
  Payload ID: 9880
  Gene Symbol: MAML3
  Gene Name: mastermind-like transcriptional coactivator 3
  ENSP ID: ENSP00000381913
MSPAEQLKQMAAQQQQRAKLMQQKQQQQQQQQQQQQQQHSNQTSNWSPLGPPSSPYGAAFTAEKPNSPMMYPQAFNNQNPIVPPMANNLQKTTMNNYLPQNHMNMINQQPNNLGTNSLNKQHNILTYGNTKPLTHFNADLSQRMTPPVANPNKNPLMPYIQQQQQQQQQQQQQQQQQQPPPPQLQAPRAHLSEDQKRLLLMKQKGVMNQPMAYAALPSHGQVSVKVTHSSSSSCGAFDCRCVMFYKSTVVGSNCLQKTSLHPQVVARFGVFFFHFS

SEQ ID NO: 49345 - protein, 1138 aa, Homo sapiens
  Payload ID: 9880
  Gene Symbol: MAML3
  Gene Name: mastermind-like transcriptional coactivator 3
  Uniprot ID: Q96JK9
  ENSP ID: ENSP00000421180
MGDFAAPAAAANGSSICINSSLNSSLGGAGIGVNNTPNSTPAAPSSNHPAAGGCGGSGGPGGGSAAVPKHSTVVERLRQRIEGCRRHHVNCENRYQQAQVEQLELERRDTVSLYQRTLEQRAKKSGAGTGKQQHPSKPQQDAEAASAEQRNHTLIMLQETVKRKLEGARSPLNGDQQNGACDGNFSPTSKRIRKDISAGMEAINNLPSNMPLPSASPLHQLDLKPSLPLQNSGTHTPGLLEDLSKNGRLPEIKLPVNGCSDLEDSFTILQSKDLKQEPLDDPTCIDTSETSLSNQNKLFSDINLNDQEWQELIDELANTVPEDDIQDLFNEDFEEKKEPEFSQPATETPLSQESASVKSDPSHSPFAHVSMGSPQARPSSSGPPFSTVSTATSLPSVASTPAAPNPASSPANCAVQSPQTPNQAHTPGQAPPRPGNGYLLNPAAVTVAGSASGPVAVPSSDMSPAEQLKQMAAQQQQRAKLMQQKQQQQQQQQQQQQQQQQQQQQQQQQQHSNQTSNWSPLGPPSSPYGAAFTAEKPNSPMMYPQAFNNQNPIVPPMANNLQKTTMNNYLPQNHMNMINQQPNNLGTNSLNKQHNILTYGNTKPLTHFNADLSQRMTPPVANPNKNPLMPYIQQQQQQQQQQQQQQQQQQPPPPQLQAPRAHLSEDQKRLLLMKQKGVMNQPMAYAALPSHGQEQHPVGLPRTTGPMQSSVPPGSGGMVSGASPAGPGFLGSQPQAAIMKQMLIDQRAQLIEQQKQQFLREQRQQQQQQQQQILAEQQLQQSHLPRQHLQPQRNPYPVQQVNQFQGSPQDIAAVRSQAALQSMRTSRLMAQNAGMMGIGPSQNPGTMATAAAQSEMGLAPYSTTPTSQPGMYNMSTGMTQMLQHPNQSGMSITHNQAQGPRQPASGQGVGMVSGFGQSMLVNSAITQQHPQMKGPVGQALPRPQAPPRLQSLMGTVQQGAQSWQQRSLQGMPGRTSGELGPFNNGASYPLQAGQPRLTKQHFPQGLSQSVVDANTGTVRTLNPAAMGRQMMPSLPGQQGTSQARPMVMSGLSQGVPGMPAFSQPPAQQQIPSGSFAPSSQSQAYERNAPQDVSYNYSGDGAGGSFPGLPDGADLVDSIIKGGPGDEWMQELDELFGNP

SEQ ID NO: 49346 - protein, 186 aa, Homo sapiens
  Payload ID: 9880
  Gene Symbol: MAML3
  Gene Name: mastermind-like transcriptional coactivator 3
  ENSP ID: ENSP00000422783
  MOD_RES (1)..(1): Any amino acid
XRAKKSGAGTGKQQHPSKPQQDAEAASAEQRNHTLIMEQHPVGLPRTTGPMQSSVPPGSGGMVSGASPAGPGFLGSQPQAAIMKQMLIDQRAQLIEQQKQQFLREQRQQQQQQQQQILAEQQLQQSHLPRQHLQPQRNPYPVQQVNQFQGSPQDIAAVRSQAALQSMRTSRLMAQNAGMMGIGPSQ

SEQ ID NO: 49347 - protein, 651 aa, Homo sapiens
  Payload ID: 9881
  Gene Symbol: MELK
  Gene Name: maternal embryonic leucine zipper kinase
  Uniprot ID: Q14680
  ENSP ID: ENSP00000298048
MKDYDELLKYYELHETIGTGGFAKVKLACHILTGEMVAIKIMDKNTLGSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 49348 - protein, 610 aa, Homo sapiens
  Payload ID: 9881
  Gene Symbol: MELK
  Gene Name: maternal embryonic leucine zipper kinase
  Uniprot ID: Q14680
  ENSP ID: ENSP00000437804
MKDYDELLKYYELHETIGTGGFAKVKLACHILTGEMVAIKIMDKNTLGSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 49349 - protein, 520 aa, Homo sapiens
  Payload ID: 9881
  Gene Symbol: MELK
  Gene Name: maternal embryonic leucine zipper kinase
  Uniprot ID: Q14680
  ENSP ID: ENSP00000439184
MVLEENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 49350 - protein, 603 aa, Homo sapiens
  Payload ID: 9881
  Gene Symbol: MELK
  Gene Name: maternal embryonic leucine zipper kinase
  Uniprot ID: Q14680
  ENSP ID: ENSP00000439792
MKDYDELLKYYELHETIGTGGFAKVKLACHILTGEMVAIKIMDKNTLGSDLPRIKTEIEALKNLRHQHICQLYHVLETANKIFMVLEENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 49351 - protein, 619 aa, Homo sapiens
  Payload ID: 9881
  Gene Symbol: MELK
  Gene Name: maternal embryonic leucine zipper kinase
  Uniprot ID: Q14680
  ENSP ID: ENSP00000441596
MMNFSNIMNYMKLLGQSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 49352 - protein, 580 aa, Homo sapiens
  Payload ID: 9881
  Gene Symbol: MELK
  Gene Name: maternal embryonic leucine zipper kinase
  Uniprot ID: Q14680
  ENSP ID: ENSP00000443550
MMNFSNIMNYMKLLGQYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 49353 - protein, 580 aa, Homo sapiens
  Payload ID: 9881
  Gene Symbol: MELK
  Gene Name: maternal embryonic leucine zipper kinase
  Uniprot ID: Q14680
  ENSP ID: ENSP00000445452
MKDYDELLKYYELHETIGTGGFAKVKLACHILTGEMVAIKIMDKNTLGSDLPRIKTEIEALKNLRHQHICQLYHVLETANKIFMVLEGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 49354 - protein, 165 aa, Homo sapiens
  Payload ID: 9881
  Gene Symbol: MELK
  Gene Name: maternal embryonic leucine zipper kinase
  ENSP ID: ENSP00000486459
MVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEMEFHCVAQAGVQWRDLGSLQPPTLGFKRFSCLSLPSSWDCRCLEHGHTVICSYVWISTI

SEQ ID NO: 49355 - protein, 129 aa, Homo sapiens
  Payload ID: 9881
  Gene Symbol: MELK
  Gene Name: maternal embryonic leucine zipper kinase
  ENSP ID: ENSP00000486558
MVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEMFGAWAYCYMFLCVDFYHLMMIM

SEQ ID NO: 49356 - protein, 157 aa, Homo sapiens
  Payload ID: 9881
  Gene Symbol: MELK
  Gene Name: maternal embryonic leucine zipper kinase
  ENSP ID: ENSP00000486717
MVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEAGVQWRDLGSLQPPTLGFKRFSCLSLPSSWDCRCLEHGHTVICSYVWISTI

SEQ ID NO: 49357 - protein, 215 aa, Homo sapiens
  Payload ID: 9881
  Gene Symbol: MELK
  Gene Name: maternal embryonic leucine zipper kinase
  ENSP ID: ENSP00000487536
MKDYDELLKYYELHETIGTGGFAKVKLACHILTGEMVAIKIMDKNTLGSDLPRIKTEIEALKNLRHQHICQLYHVLETANKIFMVLEENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWI

SEQ ID NO: 49358 - protein, 496 aa, Homo sapiens
  Payload ID: 9882
  Gene Symbol: MATN1
  Gene Name: matrilin 1, cartilage matrix protein
  Uniprot ID: P21941
  ENSP ID: ENSP00000362870
MRVLSGTSLMLCSLLLLLQALCSPGLAPQSRGHLCRTRPTDLVFVVDSSRSVRPVEFEKVKVFLSQVIESLDVGPNATRVGMVNYASTVKQEFSLRAHVSKAALLQAVRRIQPLSTGTMTGLAIQFAITKAFGDAEGGRSRSPDISKVVIVVTDGRPQDSVQDVSARARASGVELFAIGVGSVDKATLRQIASEPQDEHVDYVESYSVIEKLSRKFQEAFCVVSDLCATGDHDCEQVCISSPGSYTCACHEGFTLNSDGKTCNVCSGGGGSSATDLVFLIDGSKSVRPENFELVKKFISQIVDTLDVSDKLAQVGLVQYSSSVRQEFPLGRFHTKKDIKAAVRNMSYMEKGTMTGAALKYLIDNSFTVSSGARPGAQKVGIVFTDGRSQDYINDAAKKAKDLGFKMFAVGVGNAVEDELREIASEPVAEHYFYTADFKTINQIGKKLQKKICVEEDPCACESLVKFQAKVEGLLQALTRKLEAVSKRLAILENTVV

SEQ ID NO: 49359 - protein, 956 aa, Homo sapiens
  Payload ID: 9883
  Gene Symbol: MATN2
  Gene Name: matrilin 2
  Uniprot ID: O00339
  ENSP ID: ENSP00000254898
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 49360 - protein, 672 aa, Homo sapiens
  Payload ID: 9883
  Gene Symbol: MATN2
  Gene Name: matrilin 2
  Uniprot ID: O00339
  ENSP ID: ENSP00000429010
MEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 49361 - protein, 115 aa, Homo sapiens
  Payload ID: 9883
  Gene Symbol: MATN2
  Gene Name: matrilin 2
  ENSP ID: ENSP00000429042
MEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKT

SEQ ID NO: 49362 - protein, 155 aa, Homo sapiens
  Payload ID: 9883
  Gene Symbol: MATN2
  Gene Name: matrilin 2
  ENSP ID: ENSP00000429256
  MOD_RES (1)..(1): Any amino acid
XVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRSKMSANQPTMAANTFVLIMGIPTSANAQRDLF

SEQ ID NO: 49363 - protein, 131 aa, Homo sapiens
  Payload ID: 9883
  Gene Symbol: MATN2
  Gene Name: matrilin 2
  ENSP ID: ENSP00000429354
  MOD_RES (1)..(1): Any amino acid
XEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRYILFLHYASVWNAKNIIKTSHTLCRFYQLK

SEQ ID NO: 49364 - protein, 720 aa, Homo sapiens
  Payload ID: 9883
  Gene Symbol: MATN2
  Gene Name: matrilin 2
  ENSP ID: ENSP00000429622
  MOD_RES (1)..(1): Any amino acid
XAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRTVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTVQHRYLFEEDNLLRSTQKLSHSTKPSGSPLEEKHDQCKCENLIMFQNLANEEVRKLTQRLEEMTQRMEALENRLRYR

SEQ ID NO: 49365 - protein, 195 aa, Homo sapiens
  Payload ID: 9883
  Gene Symbol: MATN2
  Gene Name: matrilin 2
  ENSP ID: ENSP00000429825
QCYSGYALAEDGKRCVAVDYCASENHGCEHECVNADGSYLCQCHEGFALNPDKKTCTKIDYCASSNHGCQHECVNTDDSYSCHCLKGFTLNPDKKTCRSLPFFPSGINYCALNKPGCEHECVNMEESYYCRCHRGYTLDPNGKTCSRVDHCAQQDHGCEQLCLNTEDSFVCQCSEGFLINEDLKTCSRVDYCLLS

SEQ ID NO: 49366 - protein, 183 aa, Homo sapiens
  Payload ID: 9883
  Gene Symbol: MATN2
  Gene Name: matrilin 2
  ENSP ID: ENSP00000429885
  MOD_RES (1)..(1): Any amino acid
XDSCALGDHGCEHSCVSSEDSFVCQCFEGYILREDGKTCRRKDVCQAIDHGCEHICVNSDDSYTCECLEGFRLAEDGKRCRKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQG

SEQ ID NO: 49367 - protein, 937 aa, Homo sapiens
  Payload ID: 9883
  Gene Symbol: MATN2
  Gene Name: matrilin 2
  Uniprot ID: O00339
  ENSP ID: ENSP00000429977
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTVQHRYLFEEDNLLRSTQKLSHSTKPSGSPLEEKHDQCKCENLIMFQNLANEEVRKLTQRLEEMTQRMEALENRLRYR

SEQ ID NO: 49368 - protein, 915 aa, Homo sapiens
  Payload ID: 9883
  Gene Symbol: MATN2
  Gene Name: matrilin 2
  Uniprot ID: O00339
  ENSP ID: ENSP00000430221
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 49369 - protein, 176 aa, Homo sapiens
  Payload ID: 9883
  Gene Symbol: MATN2
  Gene Name: matrilin 2
  ENSP ID: ENSP00000430358
  MOD_RES (1)..(1): Any amino acid
XFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTVQHRYLFEEDNLLRSTQKLSHSTKPSGSPLEEKHDQCKCENLIMFQNLANEEQRSSLSAL

SEQ ID NO: 49370 - protein, 181 aa, Homo sapiens
  Payload ID: 9883
  Gene Symbol: MATN2
  Gene Name: matrilin 2
  ENSP ID: ENSP00000430396
  MOD_RES (1)..(1): Any amino acid
XSIGSEPHEDHVFLVANFSQIETLTSVFQKKLCIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYC

SEQ ID NO: 49371 - protein, 956 aa, Homo sapiens; identical to SEQ ID NO: 49359
  Payload ID: 9883
  Gene Symbol: MATN2
  Gene Name: matrilin 2
  Uniprot ID: O00339
  ENSP ID: ENSP00000430487

SEQ ID NO: 49372 - protein, 486 aa, Homo sapiens
  Payload ID: 9884
  Gene Symbol: MATN3
  Gene Name: matrilin 3
  Uniprot ID: O15232
  ENSP ID: ENSP00000383894
MPRPAPARRLPGLLLLLWPLLLLPSAAPDPVARPGFRRLETRGPGGSPGRRPSPAAPDGAPASGTSEPGRARGAGVCKSRPLDLVFIIDSSRSVRPLEFTKVKTFVSRIIDTLDIGPADTRVAVVNYASTVKIEFQLQAYTDKQSLKQAVGRITPLSTGTMSGLAIQTAMDEAFTVEAGAREPSSNIPKVAIIVTDGRPQDQVNEVAARAQASGIELYAVGVDRADMASLKMMASEPLEEHVFYVETYGVIEKLSSRFQETFCALDPCVLGTHQCQHVCISDGEGKHHCECSQGYTLNADKKTCSALDRCALNTHGCEHICVNDRSGSYHCECYEGYTLNEDRKTCSAQDKCALGTHGCQHICVNDRTGSHHCECYEGYTLNADKKTCSVRDKCALGSHGCQHICVSDGAASYHCDCYPGYTLNEDKKTCSATEEARRLVSTEDACGCEATLAFQDKVSSYLQRLNTKLDDILEKLKINEYGQIHR

SEQ ID NO: 49373 - protein, 444 aa, Homo sapiens
  Payload ID: 9884
  Gene Symbol: MATN3
  Gene Name: matrilin 3
  Uniprot ID: O15232
  ENSP ID: ENSP00000398753
MPRPAPARRLPGLLLLLWPLLLLPSAAPDPVARPGFRRLETRGPGGSPGRRPSPAAPDGAPASGTSEPGRARGAGVCKSRPLDLVFIIDSSRSVRPLEFTKVKTFVSRIIDTLDIGPADTRVAVVNYASTVKIEFQLQAYTDKQSLKQAVGRITPLSTGTMSGLAIQTAMDEAFTVEAGAREPSSNIPKVAIIVTDGRPQDQVNEVAARAQASGIELYAVGVDRADMASLKMMASEPLEEHVFYVETYGVIEKLSSRFQETFCALDRCALNTHGCEHICVNDRSGSYHCECYEGYTLNEDRKTCSAQDKCALGTHGCQHICVNDRTGSHHCECYEGYTLNADKKTCSVRDKCALGSHGCQHICVSDGAASYHCDCYPGYTLNEDKKTCSATEEARRLVSTEDACGCEATLAFQDKVSSYLQRLNTKLDDILEKLKINEYGQIHR

SEQ ID NO: 49374 - protein, 499 aa, Homo sapiens
  Payload ID: 9885
  Gene Symbol: MATN4
  Gene Name: matrilin 4
  ENSP ID: ENSP00000243983
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 49375 - protein, 540 aa, Homo sapiens
  Payload ID: 9885
  Gene Symbol: MATN4
  Gene Name: matrilin 4
  Uniprot ID: O95460
  ENSP ID: ENSP00000353819
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 49376 - protein, 622 aa, Homo sapiens
  Payload ID: 9885
  Gene Symbol: MATN4
  Gene Name: matrilin 4
  Uniprot ID: O95460
  ENSP ID: ENSP00000361840
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCGKDQCAEGGHGCQHQCVNAWAMFHCTCNPGYKLAADNKSCLAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 49377 - protein, 581 aa, Homo sapiens
  Payload ID: 9885
  Gene Symbol: MATN4
  Gene Name: matrilin 4
  Uniprot ID: O95460
  ENSP ID: ENSP00000361842
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 49378 - protein, 581 aa, Homo sapiens; identical to SEQ ID NO: 49377
  Payload ID: 9885
  Gene Symbol: MATN4
  Gene Name: matrilin 4
  Uniprot ID: O95460
  ENSP ID: ENSP00000440328

SEQ ID NO: 49379 - protein, 847 aa, Homo sapiens
  Payload ID: 9886
  Gene Symbol: MATR3
  Gene Name: matrin 3
  Uniprot ID: P43243
  ENSP ID: ENSP00000378284
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 49380 - protein, 77 aa, Homo sapiens
  Payload ID: 9886
  Gene Symbol: MATR3
  Gene Name: matrin 3
  ENSP ID: ENSP00000421145
MSKSFQQSSLSRDSQGHGRDLSAAGIGLLAAATQSLSMPASLGRMNQGTARLASLMNLGMSSSLNQQGAHSALSSAS

SEQ ID NO: 49381 - protein, 334 aa, Homo sapiens
  Payload ID: 9886
  Gene Symbol: MATR3
  Gene Name: matrin 3
  ENSP ID: ENSP00000422054
  MOD_RES (1)..(1): Any amino acid
XERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKK

SEQ ID NO: 49382 - protein, 78 aa, Homo sapiens
  Payload ID: 9886
  Gene Symbol: MATR3
  Gene Name: matrin 3
  ENSP ID: ENSP00000422137
MSKSFQQSSLSRDSQGHGRDLSAAGIGLLAAATQSLSMPASLGRMNQGTARLASLMNLGMSSSLNQQGAHSALSSAST

SEQ ID NO: 49383 - protein, 87 aa, Homo sapiens
  Payload ID: 9886
  Gene Symbol: MATR3
  Gene Name: matrin 3
  ENSP ID: ENSP00000422590
MSKSFQQSSLSRDSQGHGRDLSAAGIGLLAAATQSLSMPASLGRMNQGTARLASLMNLGMSSSLNQQGAHSALSSASTSSHNLQSIF

SEQ ID NO: 49384 - protein, 121 aa, Homo sapiens
  Payload ID: 9886
  Gene Symbol: MATR3
  Gene Name: matrin 3
  ENSP ID: ENSP00000422649
MDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKI

SEQ ID NO: 49385 - protein, 109 aa, Homo sapiens
  Payload ID: 9886
  Gene Symbol: MATR3
  Gene Name: matrin 3
  ENSP ID: ENSP00000422700
MGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDA

SEQ ID NO: 49386 - protein, 433 aa, Homo sapiens
  Payload ID: 9886
  Gene Symbol: MATR3
  Gene Name: matrin 3
  ENSP ID: ENSP00000423290
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNK

SEQ ID NO: 49387 - protein, 559 aa, Homo sapiens
  Payload ID: 9886
  Gene Symbol: MATR3
  Gene Name: matrin 3
  Uniprot ID: P43243
  ENSP ID: ENSP00000423587
MLGAQWRRNQPSRAAEEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 49388 - protein, 86 aa, Homo sapiens
  Payload ID: 9886
  Gene Symbol: MATR3
  Gene Name: matrin 3
  ENSP ID: ENSP00000424646
MGDPFMLQQSTNPAPGILGPPPPSFHLGGPAVGPRGNLGAGNGNLQGPRHMQKGRVETSRVVHIMDFQRGKNLRYQLLQLVEPFGV

SEQ ID NO: 49389 - protein, 124 aa, Homo sapiens
  Payload ID: 9886
  Gene Symbol: MATR3
  Gene Name: matrin 3
  ENSP ID: ENSP00000425150
MGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVF

SEQ ID NO: 49390 - protein, 9 aa, Homo sapiens
  Payload ID: 9886
  Gene Symbol: MATR3
  Gene Name: matrin 3
  ENSP ID: ENSP00000425167
MSKSFQQSS

SEQ ID NO: 49391 - protein, 509 aa, Homo sapiens
  Payload ID: 9886
  Gene Symbol: MATR3
  Gene Name: matrin 3
  ENSP ID: ENSP00000426030
MGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 49392 - protein, 794 aa, Homo sapiens
  Payload ID: 9886
  Gene Symbol: MATR3
  Gene Name: matrin 3
  ENSP ID: ENSP00000426743
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVEISE

SEQ ID NO: 49393 - protein, 100 aa, Homo sapiens
  Payload ID: 9886
  Gene Symbol: MATR3
  Gene Name: matrin 3
  ENSP ID: ENSP00000426801
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQ

SEQ ID NO: 49394 - protein, 172 aa, Homo sapiens
  Payload ID: 9886
  Gene Symbol: MATR3
  Gene Name: matrin 3
  ENSP ID: ENSP00000427557
MLGAQWRRNQPSRAAEVSGPGGKHAAGQGPRVRREILGEEEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINE

SEQ ID NO: 49395 - protein, 847 aa, Homo sapiens; identical to SEQ ID NO: 49379
  Payload ID: 9887
  Gene Symbol:
  Gene Name: matrin 3 [Source:EntrezGene
  Acc:9782]
  ENSP ID: ENSP00000354346

SEQ ID NO: 49396 - protein, 895 aa, Homo sapiens
  Payload ID: 9887
  Gene Symbol:
  Gene Name: matrin 3 [Source:EntrezGene
  Acc:9782]
  ENSP ID: ENSP00000378279
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKRRFPGSMEGFVTLDEVGDEEDSELQKLRKSGMAFKSGDKNDDGLVEIKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 49397 - protein, 509 aa, Homo sapiens; identical to SEQ ID NO: 49391
  Payload ID: 9887
  Gene Symbol:
  Gene Name: matrin 3 [Source:EntrezGene
  Acc:9782]
  ENSP ID: ENSP00000421218

SEQ ID NO: 49398 - protein, 81 aa, Homo sapiens
  Payload ID: 9887
  Gene Symbol:
  Gene Name: matrin 3 [Source:EntrezGene
  Acc:9782]
  ENSP ID: ENSP00000421666
MGDPFMLQQSTNPAPGILGPPPPSFHLGGPAVGPRGNLGAGNGNLQGPRHMQKGRVETSRVVHIMDFQRGKNLRYQLLQLV

SEQ ID NO: 49399 - protein, 107 aa, Homo sapiens
  Payload ID: 9887
  Gene Symbol:
  Gene Name: matrin 3 [Source:EntrezGene
  Acc:9782]
  ENSP ID: ENSP00000422233
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQ

SEQ ID NO: 49400 - protein, 895 aa, Homo sapiens; identical to SEQ ID NO: 49396
  Payload ID: 9887
  Gene Symbol:
  Gene Name: matrin 3 [Source:EntrezGene
  Acc:9782]
  ENSP ID: ENSP00000422319

SEQ ID NO: 49401 - protein, 63 aa, Homo sapiens
  Payload ID: 9887
  Gene Symbol:
  Gene Name: matrin 3 [Source:EntrezGene
  Acc:9782]
  ENSP ID: ENSP00000423521
MQLQEWSQHINGASHSRRCQLLLEIYPEWNPDNDTGHTMGDPFMLQQSTNPAPGILGPPPPSF

SEQ ID NO: 49402 - protein, 847 aa, Homo sapiens; identical to SEQ ID NO: 49379
  Payload ID: 9887
  Gene Symbol:
  Gene Name: matrin 3 [Source:EntrezGene
  Acc:9782]
  Uniprot ID: P43243
  ENSP ID: ENSP00000423533

SEQ ID NO: 49403 - protein, 6 aa, Homo sapiens
  Payload ID: 9887
  Gene Symbol:
  Gene Name: matrin 3 [Source:EntrezGene
  Acc:9782]
  ENSP ID: ENSP00000423695
MGDPFM

SEQ ID NO: 49404 - protein, 47 aa, Homo sapiens
  Payload ID: 9887
  Gene Symbol:
  Gene Name: matrin 3 [Source:EntrezGene
  Acc:9782]
  ENSP ID: ENSP00000424431
MSKSFQQSSLSRDSQGHGRDLSAAGIGLLAAATQSLSMPASLGRMNQ

SEQ ID NO: 49405 - protein, 99 aa, Homo sapiens
  Payload ID: 9887
  Gene Symbol:
  Gene Name: matrin 3 [Source:EntrezGene
  Acc:9782]
  ENSP ID: ENSP00000427168
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSS

SEQ ID NO: 49406 - protein, 283 aa, Homo sapiens
  Payload ID: 9887
  Gene Symbol:
  Gene Name: matrin 3 [Source:EntrezGene
  Acc:9782]
  ENSP ID: ENSP00000480093
MSKSFQQSSLSRDSQGHGRDLSAAGIGLLAAATQSLSMLLESEDELLVDEEEAAALLESGSSVGDETDLANLGDVASDGKKEPSDKAVKKDGSASAAAKKKLKKRRFPGSMEGFVTLDEVGDEEDSELQKLRKSGMAFKSGDKNDDGLVEIKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 49407 - protein, 847 aa, Homo sapiens; identical to SEQ ID NO: 49379
  Payload ID: 9887
  Gene Symbol:
  Gene Name: matrin 3 [Source:EntrezGene
  Acc:9782]
  Uniprot ID: P43243
  ENSP ID: ENSP00000482895

SEQ ID NO: 49408 - protein, 525 aa, Homo sapiens
  Payload ID: 9888
  Gene Symbol: MEPE
  Gene Name: matrix extracellular phosphoglycoprotein
  Uniprot ID: Q9NQ76
  ENSP ID: ENSP00000354341
MRVFCVGLLLFSVTWAAPTFQPQTEKTKQSCVEEQRQEEKNKDNIGFHHLGKRINQELSSKENIVQERKKDLSLSEASENKGSSKSQNYFTNRQRLNKEYSISNKENTHNGLRMSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 49409 - protein, 556 aa, Homo sapiens
  Payload ID: 9888
  Gene Symbol: MEPE
  Gene Name: matrix extracellular phosphoglycoprotein
  Uniprot ID: Q9NQ76
  ENSP ID: ENSP00000378534
MRVFCVGLLLFSVTWAAPTFQPQTEKTKQSCVEEQRITYKGHYEKHGHYVFKCVYMSPEKKNQTDVKQEEKNKDNIGFHHLGKRINQELSSKENIVQERKKDLSLSEASENKGSSKSQNYFTNRQRLNKEYSISNKENTHNGLRMSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 49410 - protein, 525 aa, Homo sapiens; identical to SEQ ID NO: 49408
  Payload ID: 9888
  Gene Symbol: MEPE
  Gene Name: matrix extracellular phosphoglycoprotein
  Uniprot ID: Q9NQ76
  ENSP ID: ENSP00000416984

SEQ ID NO: 49411 - protein, 96 aa, Homo sapiens
  Payload ID: 9888
  Gene Symbol: MEPE
  Gene Name: matrix extracellular phosphoglycoprotein
  ENSP ID: ENSP00000421430
MRVFCVGLLLFSVTWAAPTFQPQTEKTKQSCVEEQRAPQASLLQNSGSQNLPDPHPMPRPTSRSASGPVAAGVILMDLSRKKKTKTILVFTIWARE

SEQ ID NO: 49412 - protein, 501 aa, Homo sapiens
  Payload ID: 9888
  Gene Symbol: MEPE
  Gene Name: matrix extracellular phosphoglycoprotein
  ENSP ID: ENSP00000422747
MSPEKKNQTDVKQEEKNKDNIGFHHLGKRINQELSSKENIVQERKKDLSLSEASENKGSSKSQNYFTNRQRLNKEYSISNKENTHNGLRMSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 49413 - protein, 412 aa, Homo sapiens
  Payload ID: 9888
  Gene Symbol: MEPE
  Gene Name: matrix extracellular phosphoglycoprotein
  Uniprot ID: Q9NQ76
  ENSP ID: ENSP00000443491
MSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 49414 - protein, 412 aa, Homo sapiens; identical to SEQ ID NO: 49413
  Payload ID: 9888
  Gene Symbol: MEPE
  Gene Name: matrix extracellular phosphoglycoprotein
  Uniprot ID: Q9NQ76
  ENSP ID: ENSP00000453994

SEQ ID NO: 49415 - protein, 128 aa, Homo sapiens
  Payload ID: 9889
  Gene Symbol: MGP
  Gene Name: matrix Gla protein
  Uniprot ID: P08493
  ENSP ID: ENSP00000228938
MKSLILLAILAALAVVTLCYGEWQKEENFGFDIVSVLSLNWHRAQESHESMESYELNPFINRRNANTFISPQQRWRAKVQERIRERSKPVHELNREACDDYRLCERYAMVYGYNAAYNRYFRKRRGTK

SEQ ID NO: 49416 - protein, 74 aa, Homo sapiens
  Payload ID: 9889
  Gene Symbol: MGP
  Gene Name: matrix Gla protein
  ENSP ID: ENSP00000445436
  MOD_RES (1)..(1): Any amino acid
XSHESMESYELRSENALSLSTSSIGKPVMTTDFANATPWFMDTMLPIIATSGSAEGPNETEGRKKISFFLEAGT

SEQ ID NO: 49417 - protein, 103 aa, Homo sapiens
  Payload ID: 9889
  Gene Symbol: MGP
  Gene Name: matrix Gla protein
  Uniprot ID: P08493
  ENSP ID: ENSP00000445907
MKSLILLAILAALAVVTLCYESHESMESYELNPFINRRNANTFISPQQRWRAKVQERIRERSKPVHELNREACDDYRLCERYAMVYGYNAAYNRYFRKRRGTK

SEQ ID NO: 49418 - protein, 469 aa, Homo sapiens
  Payload ID: 9890
  Gene Symbol: MMP1
  Gene Name: matrix metallopeptidase 1
  Uniprot ID: P03956
  ENSP ID: ENSP00000322788
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 49419 - protein, 476 aa, Homo sapiens
  Payload ID: 9891
  Gene Symbol: MMP10
  Gene Name: matrix metallopeptidase 10
  Uniprot ID: P09238
  ENSP ID: ENSP00000279441
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 49420 - protein, 181 aa, Homo sapiens
  Payload ID: 9891
  Gene Symbol: MMP10
  Gene Name: matrix metallopeptidase 10
  ENSP ID: ENSP00000441485
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKGHSLAHAYPPGPGLYG

SEQ ID NO: 49421 - protein, 488 aa, Homo sapiens
  Payload ID: 9892
  Gene Symbol: MMP11
  Gene Name: matrix metallopeptidase 11
  Uniprot ID: P24347
  ENSP ID: ENSP00000215743
MAPAAWLRSAAARALLPPMLLLLLQPPPLLARALPPDAHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGYAYFLRGRLYWKFDPVKVKALEGFPRLVGPDFFGCAEPANTFL

SEQ ID NO: 49422 - protein, 354 aa, Homo sapiens
  Payload ID: 9892
  Gene Symbol: MMP11
  Gene Name: matrix metallopeptidase 11
  ENSP ID: ENSP00000408070
MAPAAWLRSAAARALLPPMLLLLLQPPPLLARALPPDAHHLHAERRGPQPWHAALPSSPAPAPATQEAPRPASSLRPPRCGVPDPSDGLSARNRQKRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGTTGVSTPAPGV

SEQ ID NO: 49423 - protein, 113 aa, Homo sapiens
  Payload ID: 9892
  Gene Symbol: MMP11
  Gene Name: matrix metallopeptidase 11
  ENSP ID: ENSP00000409860
MAPAAWLRSAAARALLPPMLLLLLQPPPLLARALPPDAHHLHAERRGPQPWHAALPSSPAPAPATQEAPRPASSLRPPRCGVPDPSDGLSARNRQKRFVLSGGRWEKTDLTYR

SEQ ID NO: 49424 - protein, 170 aa, Homo sapiens
  Payload ID: 9892
  Gene Symbol: MMP11
  Gene Name: matrix metallopeptidase 11
  ENSP ID: ENSP00000412107
  MOD_RES (1)..(1): Any amino acid
XAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQELGFPSSTGRDESLEHCRCQGLHK

SEQ ID NO: 49425 - protein, 488 aa, Homo sapiens; identical to SEQ ID NO: 49421
  Payload ID: 9892
  Gene Symbol: MMP11
  Gene Name: matrix metallopeptidase 11
  Uniprot ID: P24347
  ENSP ID: ENSP00000483349

SEQ ID NO: 49426 - protein, 170 aa, Homo sapiens; identical to SEQ ID NO: 49424
  Payload ID: 9892
  Gene Symbol: MMP11
  Gene Name: matrix metallopeptidase 11
  ENSP ID: ENSP00000486195
  MOD_RES (1)..(1): Any amino acid

SEQ ID NO: 49427 - protein, 354 aa, Homo sapiens; identical to SEQ ID NO: 49422
  Payload ID: 9892
  Gene Symbol: MMP11
  Gene Name: matrix metallopeptidase 11
  ENSP ID: ENSP00000486551

SEQ ID NO: 49428 - protein, 470 aa, Homo sapiens
  Payload ID: 9893
  Gene Symbol: MMP12
  Gene Name: matrix metallopeptidase 12
  Uniprot ID: P39900
  ENSP ID: ENSP00000458585
MKFLLILLLQATASGALPLNSSTSLEKNNVLFGERYLEKFYGLEINKLPVTKMKYSGNLMKEKIQEMQHFLGLKVTGQLDTSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 49429 - protein, 471 aa, Homo sapiens
  Payload ID: 9894
  Gene Symbol: MMP13
  Gene Name: matrix metallopeptidase 13
  Uniprot ID: P45452
  ENSP ID: ENSP00000260302
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNGYIYFFNGPIQFEYSIWSNRIVRVMPANSILWC

SEQ ID NO: 49430 - protein, 489 aa, Homo sapiens
  Payload ID: 9894
  Gene Symbol: MMP13
  Gene Name: matrix metallopeptidase 13
  ENSP ID: ENSP00000339672
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNESHSVTQAGVHCRNLSSLQPPPPGFKRFSCLSLWSSWDYRLYLFFQRTHTV

SEQ ID NO: 49431 - protein, 383 aa, Homo sapiens [sequence omitted]

SEQ ID NO: 49432 - protein, 582 aa, Homo sapiens
  Payload ID: 9895
  Gene Symbol: MMP14
  Gene Name: matrix metallopeptidase 14 (membrane-inserted)
  Uniprot ID: P50281
  ENSP ID: ENSP00000308208
MSPAPRPPRCLLLPLLTLGTALASLGSAQSSSFSPEAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 49433 - protein, 194 aa, Homo sapiens
  Payload ID: 9895
  Gene Symbol: MMP14
  Gene Name: matrix metallopeptidase 14 (membrane-inserted)
  ENSP ID: ENSP00000446989
MRESLLFLRLPSSPALSRRRALRWALRPPRVAQAFSGRVCGQAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGD

SEQ ID NO: 49434 - protein, 71 aa, Homo sapiens
  Payload ID: 9895
  Gene Symbol: MMP14
  Gene Name: matrix metallopeptidase 14 (membrane-inserted)
  ENSP ID: ENSP00000450323
MSPAPRPPRCLLLPLLTLGTALASLGSAQSSSFSPESLEELYNWGELPLPRFPWALLSALEPPDKHLDSAQ

SEQ ID NO: 49435 - protein, 669 aa, Homo sapiens
  Payload ID: 9896
  Gene Symbol: MMP15
  Gene Name: matrix metallopeptidase 15 (membrane-inserted)
  Uniprot ID: P51511
  ENSP ID: ENSP00000219271
MGSDPSAPGRPGWTGSLLGDREEAARPRLLPLLLVLLGCLGLGVAAEDAEVHAENWLRLYGYLPQPSRHMSTMRSAQILASALAEMQRFYGIPVTGVLDEETKEWMKRPRCGVPDQFGVRVKANLRRRRKRYALTGRKWNNHHLTFSIQNYTEKLGWYHSMEAVRRAFRVWEQATPLVFQEVPYEDIRLRRQKEADIMVLFASGFHGDSSPFDGTGGFLAHAYFPGPGLGGDTHFDADEPWTFSSTDLHGNNLFLVAVHELGHALGLEHSSNPNAIMAPFYQWKDVDNFKLPEDDLRGIQQLYGTPDGQPQPTQPLPTVTPRRPGRPDHRPPRPPQPPPPGGKPERPPKPGPPVQPRATERPDQYGPNICDGDFDTVAMLRGEMFVFKGRWFWRVRHNRVLDNYPMPIGHFWRGLPGDISAAYERQDGRFVFFKGDRYWLFREANLEPGYPQPLTSYGLGIPYDRIDTAIWWEPTGHTFFFQEDRYWRFNEETQRGDPGYPKPISVWQGIPASPKGAFLSNDAAYTYFYKGTKYWKFDNERLRMEPGYPKSILRDFMGCQEHVEPGPRWPDVARPPFNPHGGAEPGADSAEGDVGDGDGDFGAGVNKDGGSRVVVQMEEVARTVNVVMVLVPLLLLLCVLGLTYALVQMQRKGAPRVLLYCKRSLQEWV

SEQ ID NO: 49436 - protein, 97 aa, Homo sapiens
  Payload ID: 9896
  Gene Symbol: MMP15
  Gene Name: matrix metallopeptidase 15 (membrane-inserted)
  ENSP ID: ENSP00000457084
  MOD_RES (1)..(1): Any amino acid
XSTDLHGNNLFLVAVHELGHALGLEHSSNPNAIMAPFYQWKDVDNFKLPEDDLRGIQQLYGAWAVTSGLCMPLSSPWPMRSRHCCHPHFVDEEPKAQ

SEQ ID NO: 49437 - protein, 607 aa, Homo sapiens
  Payload ID: 9897
  Gene Symbol: MMP16
  Gene Name: matrix metallopeptidase 16 (membrane-inserted)
  Uniprot ID: P51512
  ENSP ID: ENSP00000286614
MILLTFSTGRRLDFVHHSGVFFLQTLLWILCATVCGTEQYFNVEVWLQKYGYLPPTDPRMSVLRSAETMQSALAAMQQFYGINMTGKVDRNTIDWMKKPRCGVPDQTRGSSKFHIRRKRYALTGQKWQHKHITYSIKNVTPKVGDPETRKAIRRAFDVWQNVTPLTFEEVPYSELENGKRDVDITIIFASGFHGDSSPFDGEGGFLAHAYFPGPGIGGDTHFDSDEPWTLGNPNHDGNDLFLVAVHELGHALGLEHSNDPTAIMAPFYQYMETDNFKLPNDDLQGIQKIYGPPDKIPPPTRPLPTVPPHRSIPPADPRKNDRPKPPRPPTGRPSYPGAKPNICDGNFNTLAILRREMFVFKDQWFWRVRNNRVMDGYPMQITYFWRGLPPSIDAVYENSDGNFVFFKGNKYWVFKDTTLQPGYPHDLITLGSGIPPHGIDSAIWWEDVGKTYFFKGDRYWRYSEEMKTMDPGYPKPITVWKGIPESPQGAFVHKENGFTYFYKGKEYWKFNNQILKVEPGYPRSILKDFMGCDGPTDRVKEGHSPPDDVDIVIKLDNTASTVKAIAIVIPCILALCLLVLVYTVFQFKRKGTPRHILYCKRSMQEWV

SEQ ID NO: 49438 - protein, 168 aa, Homo sapiens
  Payload ID: 9897
  Gene Symbol: MMP16
  Gene Name: matrix metallopeptidase 16 (membrane-inserted)
  ENSP ID: ENSP00000429147
MRDGRYCRRAVLKPGPLSRAGYLRTGRRLDFVHHSGVFFLQTLLWILCATVCGTEQYFNVEVWLQKYGYLPPTDPRMSVLRSAETMQSALAAMQQFYGINMTGKVDRNTIDWMKKPRCGVPDQTRGSSKFHIRRKRYALTGQKWQHKHITYSIKNVTPKVGDPETRKA

SEQ ID NO: 49439 - protein, 603 aa, Homo sapiens
  Payload ID: 9898
  Gene Symbol: MMP17
  Gene Name: matrix metallopeptidase 17 (membrane-inserted)
  Uniprot ID: Q9ULZ9
  ENSP ID: ENSP00000353767
MRRRAARGPGPPPPGPGLSRLPLPLLLLLALGTRGGCAAPAPAPRAEDLSLGVEWLSRFGYLPPADPTTGQLQTQEELSKAITAMQQFGGLEATGILDEATLALMKTPRCSLPDLPVLTQARRRRQAPAPTKWNKRNLSWRVRTFPRDSPLGHDTVRALMYYALKVWSDIAPLNFHEVAGSAADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 49440 - protein, 118 aa, Homo sapiens
  Payload ID: 9898
  Gene Symbol: MMP17
  Gene Name: matrix metallopeptidase 17 (membrane-inserted)
  ENSP ID: ENSP00000439542
MHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDG

SEQ ID NO: 49441 - protein, 519 aa, Homo sapiens
  Payload ID: 9898
  Gene Symbol: MMP17
  Gene Name: matrix metallopeptidase 17 (membrane-inserted)
  Uniprot ID: Q9ULZ9
  ENSP ID: ENSP00000441106
MQQFGGLEATGILDEATLALMKTPRCSLPDLPVLTQARRRRQAPAPTKWNKRNLSWRVRTFPRDSPLGHDTVRALMYYALKVWSDIAPLNFHEVAGSAADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 49442 - protein, 115 aa, Homo sapiens
  Payload ID: 9898
  Gene Symbol: MMP17
  Gene Name: matrix metallopeptidase 17 (membrane-inserted)
  ENSP ID: ENSP00000441710
MQQFGGLEATGILDEATLALMKTPRCSLPDLPVLTQARRRRQAPAPTKWNKRNLSWRVRTFPRDSPLGHDTVRALMYYALKVWSDIAPLNFHEVAGSAADIQIDFSKADHNDGYP

SEQ ID NO: 49443 - protein, 302 aa, Homo sapiens
  Payload ID: 9898
  Gene Symbol: MMP17
  Gene Name: matrix metallopeptidase 17 (membrane-inserted)
  ENSP ID: ENSP00000442104
MYYALKVWSDIAPLNFHEVAGSAADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHM

SEQ ID NO: 49444 - protein, 39 aa, Homo sapiens
  Payload ID: 9898
  Gene Symbol: MMP17
  Gene Name: matrix metallopeptidase 17 (membrane-inserted)
  ENSP ID: ENSP00000443727
MHRFWRGLPLHLDSVDAVYERTSDHKIVFFKGPAVLALR

SEQ ID NO: 49445 - protein, 169 aa, Homo sapiens
  Payload ID: 9898
  Gene Symbol: MMP17
  Gene Name: matrix metallopeptidase 17 (membrane-inserted)
  ENSP ID: ENSP00000444603
MKTPRCSLPDLPVLTQARRRRQAPAPTKWNKRNLSWRVRTFPRDSPLGHDTVRALMYYALKVWSDIAPLNFHEVAGSAADIQIDFSKADHNDGYPFDGPGGTVAHAFFPGHHHTAGDTHFDDDEAWTFRSSDAHGMDLFAVAVHEFGHAIGLSHVAAAHSIMRPYYQGP

SEQ ID NO: 49446 - protein, 143 aa, Homo sapiens
  Payload ID: 9898
  Gene Symbol: MMP17
  Gene Name: matrix metallopeptidase 17 (membrane-inserted)
  ENSP ID: ENSP00000445620
MDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 49447 - protein, 508 aa, Homo sapiens
  Payload ID: 9899
  Gene Symbol: MMP19
  Gene Name: matrix metallopeptidase 19
  Uniprot ID: Q99542
  ENSP ID: ENSP00000313437
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 49448 - protein, 305 aa, Homo sapiens
  Payload ID: 9899
  Gene Symbol: MMP19
  Gene Name: matrix metallopeptidase 19
  Uniprot ID: Q99542
  ENSP ID: ENSP00000386625
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGKKSPVIRDEEEEETELPTVPPVPTEPSPMPDPCSSELDAMMLGEAPPLQAVGRRWGQPADPEAWTNGSDMGLQHEQWRAPWEDLCFQGGLCVDCIRFRTGPLVPSVCPLGGAPRKPGCCCLLASNTMDSLL

SEQ ID NO: 49449 - protein, 63 aa, Homo sapiens
  Payload ID: 9899
  Gene Symbol: MMP19
  Gene Name: matrix metallopeptidase 19
  Uniprot ID: Q99542
  ENSP ID: ENSP00000446776
MNCQQLWLGFLLPMTVSGRVLGLAEVAPVDYLSQYGYLQKPLEGSNNFKPEDITEALSLRSAG

SEQ ID NO: 49450 - protein, 485 aa, Homo sapiens
  Payload ID: 9899
  Gene Symbol: MMP19
  Gene Name: matrix metallopeptidase 19
  ENSP ID: ENSP00000446979
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 49451 - protein, 81 aa, Homo sapiens
  Payload ID: 9899
  Gene Symbol: MMP19
  Gene Name: matrix metallopeptidase 19
  ENSP ID: ENSP00000447363
MNCQQLWLGFLLPMTVSGRVLGLAEVAPVDYLSQYGYLQKPLEGSNNFKPEDITEALRESPGPCRHPRAGQCALRRRRVLD

SEQ ID NO: 49452 - protein, 108 aa, Homo sapiens
  Payload ID: 9899
  Gene Symbol: MMP19
  Gene Name: matrix metallopeptidase 19
  ENSP ID: ENSP00000449752
MNCQQLWLGFLLPMTVSGRVLGLAEVAPVDYLSQYGYLQKPLEGSNNFKPEDITEALRPLEKEAPDFPHLEPALHPSTPHSPGSPASSLPGLEQCGSLDLPRGAGWCG

SEQ ID NO: 49453 - protein, 660 aa, Homo sapiens
  Payload ID: 9900
  Gene Symbol: MMP2
  Gene Name: matrix metallopeptidase 2
  Uniprot ID: P08253
  ENSP ID: ENSP00000219070
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 49454 - protein, 610 aa, Homo sapiens
  Payload ID: 9900
  Gene Symbol: MMP2
  Gene Name: matrix metallopeptidase 2
  Uniprot ID: P08253
  ENSP ID: ENSP00000394237
MQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 49455 - protein, 584 aa, Homo sapiens
  Payload ID: 9900
  Gene Symbol: MMP2
  Gene Name: matrix metallopeptidase 2
  Uniprot ID: P08253
  ENSP ID: ENSP00000444143
MQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 49456 - protein, 201 aa, Homo sapiens
  Payload ID: 9900
  Gene Symbol: MMP2
  Gene Name: matrix metallopeptidase 2
  ENSP ID: ENSP00000456096
MQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHE

SEQ ID NO: 49457 - protein, 251 aa, Homo sapiens
  Payload ID: 9900
  Gene Symbol: MMP2
  Gene Name: matrix metallopeptidase 2
  ENSP ID: ENSP00000456518
GTTEDYDRDKKYGFCPETGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGG

SEQ ID NO: 49458 - protein, 118 aa, Homo sapiens
  Payload ID: 9900
  Gene Symbol: MMP2
  Gene Name: matrix metallopeptidase 2
  ENSP ID: ENSP00000457949
MQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHA

SEQ ID NO: 49459 - protein, 584 aa, Homo sapiens; identical to SEQ ID NO: 49455
  Payload ID: 9900
  Gene Symbol: MMP2
  Gene Name: matrix metallopeptidase 2
  Uniprot ID: P08253
  ENSP ID: ENSP00000461421

SEQ ID NO: 49460 - protein, 22 aa, Homo sapiens
  Payload ID: 9900
  Gene Symbol: MMP2
  Gene Name: matrix metallopeptidase 2
  ENSP ID: ENSP00000461915
  MOD_RES (1)..(1): Any amino acid
XLENQSLKSVKFGSIKSDWLGC

SEQ ID NO: 49461 - protein, 483 aa, Homo sapiens
  Payload ID: 9901
  Gene Symbol: MMP20
  Gene Name: matrix metallopeptidase 20
  Uniprot ID: O60882
  ENSP ID: ENSP00000260228
MKVLPASGLAVFLIMALKFSTAAPSLVAASPRTWRNNYRLAQAYLDKYYTNKEGHQIGEMVARGSNSMIRKIKELQAFFGLQVTGKLDQTTMNVIKKPRCGVPDVANYRLFPGEPKWKKNTLTYRISKYTPSMSSVEVDKAVEMALQAWSSAVPLSFVRINSGEADIMISFENGDHGDSYPFDGPRGTLAHAFAPGEGLGGDTHFDNAEKWTMGTNGFNLFTVAAHEFGHALGLAHSTDPSALMYPTYKYKNPYGFHLPKDDVKGIQALYGPRKVFLGKPTLPHAPHHKPSIPDLCDSSSSFDAVTMLGKELLLFKDRIFWRRQVHLRTGIRPSTITSSFPQLMSNVDAAYEVAERGTAYFFKGPHYWITRGFQMQGPPRTIYDFGFPRHVQQIDAAVYLREPQKTLFFVGDEYYSYDERKRKMEKDYPKNTEEEFSGVNGQIDAAVELNGYIYFFSGPKTYKYDTEKEDVVSVVKSSSWIGC

SEQ ID NO: 49462 - protein, 569 aa, Homo sapiens
  Payload ID: 9902
  Gene Symbol: MMP21
  Gene Name: matrix metallopeptidase 21
  Uniprot ID: Q8N119
  ENSP ID: ENSP00000357798
MLAASIFRPTLLLCWLAAPWPTQPESLFHSRDRSDLEPSPLRQAKPIADLHAAQRFLSRYGWSGVWAAWGPSPEGPPETPKGAALAEAVRRFQRANALPASGELDAATLAAMNRPRCGVPDMRPPPPSAPPSPPGPPPRARSRRSPRAPLSLSRRGWQPRGYPDGGAAQAFSKRTLSWRLLGEALSSQLSVADQRRIVALAFRMWSEVTPLDFREDLAAPGAAVDIKLGFGRGRHLGCPRAFDGSGQEFAHAWRLGDIHFDDDEHFTPPTSDTGISLLKVAVHEIGHVLGLPHTYRTGSIMQPNYIPQEPAFELDWSDRKAIQKLYGSCEGSFDTAFDWIRKERNQYGEVMVRFSTYFFRNSWYWLYENRNNRTRYGDPIQILTGWPGIPTHNIDAFVHIWTWKRDERYFFQGNQYWRYDSDKDQALTEDEQGKSYPKLISEGFPGIPSPLDTAFYDRRQKLIYFFKESLVFAFDVNRNRVLNSYPKRITEVFPAVIPQNHPFRNIDSAYYSYAYNSIFFFKGNAYWKVVNDKDKQQNSWLPANGLFPKKFISEKWFDVCDVHISTLNM

SEQ ID NO: 49463 - protein, 390 aa, Homo sapiens
  Payload ID: 9903
  Gene Symbol: MMP23B
  Gene Name: matrix metallopeptidase 23B
  Uniprot ID: O75900
  ENSP ID: ENSP00000348308
MGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 49464 - protein, 386 aa, Homo sapiens
  Payload ID: 9903
  Gene Symbol: MMP23B
  Gene Name: matrix metallopeptidase 23B
  ENSP ID: ENSP00000367945
MGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGGRPPPPRPGPARPASQPRAPPRLLPDQPHGLPGLRAAPLLRRPHGGAGPRLLPPARRHPLRRQRVLGPGPHALQLEERRVAHGPGARGGPRDRPRAGPDALTTRPGAHAPERHAARLEGVVPGRAVGAAPALRMPRQAVRVRVLGAEGLLRRSPAAHEEALPQQLRLLLRIPLPHGGHHPTAPQDQNQAGARGQERDLPLRPEDPPQERESVLVQGPGAPGVLLPRLPGPGRGAPEHHRQRRQ

SEQ ID NO: 49465 - protein, 242 aa, Homo sapiens
  Payload ID: 9903
  Gene Symbol: MMP23B
  Gene Name: matrix metallopeptidase 23B
  ENSP ID: ENSP00000405867
  MOD_RES (1)..(1): Any amino acid
XHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYGESLCRAGGRGPGGPEPGRAPHAPDRMPRQAVRVRVLGAEGLLRRSPAAHEEALPQQLRLLLRIPLPHGGHHPTAPQDQNQAGARGQERDLPLRPEDPPQERESVLVQGPGAPGVLLPRLPGPGRGAPEHHRQRRQ

SEQ ID NO: 49466 - protein, 238 aa, Homo sapiens
  Payload ID: 9903
  Gene Symbol: MMP23B
  Gene Name: matrix metallopeptidase 23B
  ENSP ID: ENSP00000423780
MGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGDRPGWPPGGLSSAAQWAAAVGLWGRRQEGPSGVVAATGV

SEQ ID NO: 49467 - protein, 166 aa, Homo sapiens
  Payload ID: 9903
  Gene Symbol: MMP23B
  Gene Name: matrix metallopeptidase 23B
  ENSP ID: ENSP00000424976
MGRGARVPSEAPGAGVERRWLGAALVALCLLPALVLLARLGAPAVPAWSAAQSIFRGSFWSWGPSPMPPTHAFFPEGRRRCAGPLGGPPHPGPGPTGPPQTPLHADSSQAALGPLQPHLQDPLLPAEPAEPAGDAAGPSCRLPHVERRVPLQLPRGGPRAAQRPPD

SEQ ID NO: 49468 - protein, 265 aa, Homo sapiens
  Payload ID: 9903
  Gene Symbol: MMP23B
  Gene Name: matrix metallopeptidase 23B
  ENSP ID: ENSP00000426293
GDVAALGLSAVPPTRVPGPLAPRRRRYTLTPARLRWDHFNLTYRLLPDQPHGLPGLRAAPLLRRPHGGAGPRLLPPARRHPLRRQRVLGPGPHALQLEERRVAHGPGARGGPRDRPRAGPDALTTRPGAHAPERHAARLEGVVPGRAVGAAPALRMPRQAVRVRVLGAEGLLRRSPAAHEEALPQQLRLLLRIPLPHGGHHPTAPQDQNQAGARGQERDLPLRPEDPPQERESVLVQGPGAPGVLLPRLPGPGRGAPEHHRQRRQ

SEQ ID NO: 49469 - protein, 258 aa, Homo sapiens
  Payload ID: 9903
  Gene Symbol: MMP23B
  Gene Name: matrix metallopeptidase 23B
  ENSP ID: ENSP00000426857
TTRTAWSPRCTTASTAPRGSWPTPSSPRTAASTSTTASTGSWAPRATAGRKVTVQAGLLEASPLQHSGLPRSGFGADGRRDLPGWWLPLESSRRVAHGPGARGGPRDRPRAGPDALTTRPGAHAPERHAARLEGVVPGRAVGAAPALRMPRQAVRVRVLGAEGLLRRSPAAHEEALPQQLRLLLRIPLPHGGHHPTAPQDQNQAGARGQERDLPLRPEDPPQERESVLVQGPGAPGVLLPRLPGPGRGAPEHHRQRRQ

SEQ ID NO: 49470 - protein, 87 aa, Homo sapiens
  Payload ID: 9903
  Gene Symbol: MMP23B
  Gene Name: matrix metallopeptidase 23B
  ENSP ID: ENSP00000462142
PRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 49471 - protein, 390 aa, Homo sapiens; identical to SEQ ID NO: 49463
  Payload ID: 9903
  Gene Symbol: MMP23B
  Gene Name: matrix metallopeptidase 23B
  Uniprot ID: O75900
  ENSP ID: ENSP00000482367

SEQ ID NO: 49472 - protein, 386 aa, Homo sapiens; identical to SEQ ID NO: 49464
  Payload ID: 9903
  Gene Symbol: MMP23B
  Gene Name: matrix metallopeptidase 23B
  ENSP ID: ENSP00000482664

SEQ ID NO: 49473 - protein, 645 aa, Homo sapiens
  Payload ID: 9904
  Gene Symbol: MMP24
  Gene Name: matrix metallopeptidase 24 (membrane-inserted)
  Uniprot ID: Q9Y5R2
  ENSP ID: ENSP00000246186
MPRSRGGRAAPGPPPPPPPPGQAPRWSRWRVPGRLLLLLLPALCCLPGAARAAAAAAGAGNRAAVAVAVARADEAEAPFAGQNWLKSYGYLLPYDSRASALHSAKALQSAVSTMQQFYGIPVTGVLDQTTIEWMKKPRCGVPDHPHLSRRRRNKRYALTGQKWRQKHITYSIHNYTPKVGELDTRKAIRQAFDVWQKVTPLTFEEVPYHEIKSDRKEADIMIFFASGFHGDSSPFDGEGGFLAHAYFPGPGIGGDTHFDSDEPWTLGNANHDGNDLFLVAVHELGHALGLEHSSDPSAIMAPFYQYMETHNFKLPQDDLQGIQKIYGPPAEPLEPTRPLPTLPVRRIHSPSERKHERQPRPPRPPLGDRPSTPGTKPNICDGNFNTVALFRGEMFVFKDRWFWRLRNNRVQEGYPMQIEQFWKGLPARIDAAYERADGRFVFFKGDKYWVFKEVTVEPGYPHSLGELGSCLPREGIDTALRWEPVGKTYFFKGERYWRYSEERRATDPGYPKPITVWKGIPQAPQGAFISKEGYYTYFYKGRDYWKFDNQKLSVEPGYPRNILRDWMGCNQKEVERRKERRLPQDDVDIMVTINDVPGSVNAVAVVIPCILSLCILVLVYTIFQFKNKTGPQPVTYYKRPVQEWV

SEQ ID NO: 49474 - protein, 562 aa, Homo sapiens
  Payload ID: 9905
  Gene Symbol: MMP25
  Gene Name: matrix metallopeptidase 25
  Uniprot ID: Q9NPA2
  ENSP ID: ENSP00000337816
MRLRLRLLALLLLLLAPPARAPKPSAQDVSLGVDWLTRYGYLPPPHPAQAQLQSPEKLRDAIKVMQRFAGLPETGRMDPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKDGEGTDLFAVAVHEFGHALGLGHSSAPNSIMRPFYQGPVGDPDKYRLSQDDRDGLQQLYGKAPQTPYDKPTRKPLAPPPQPPASPTHSPSFPIPDRCEGNFDAIANIRGETFFFKGPWFWRLQPSGQLVSPRPARLHRFWEGLPAQVRVVQAAYARHRDGRILLFSGPQFWVFQDRQLEGGARPLTELGLPPGEEVDAVFSWPQNGKTYLVRGRQYWRYDEAAARPDPGYPRDLSLWEGAPPSPDDVTVSNAGDTYFFKGAHYWRFPKNSIKTEPDAPQPMGPNWLDCPAPSSGPRAPRPPKATPVSETCDCQCELNQAAGRWPAPIPLLLLPLLVGGVASR

SEQ ID NO: 49475 - protein, 183 aa, Homo sapiens
  Payload ID: 9905
  Gene Symbol: MMP25
  Gene Name: matrix metallopeptidase 25
  ENSP ID: ENSP00000482854
MDPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKASQQLEQELAGGSPVDEELGFSRGWRVNPLGPGSPERLS

SEQ ID NO: 49476 - protein, 261 aa, Homo sapiens
  Payload ID: 9906
  Gene Symbol: MMP26
  Gene Name: matrix metallopeptidase 26
  Uniprot ID: Q9NRE1
  ENSP ID: ENSP00000300762
MQLVILRVTIFLPWCFAVPVPPAADHKGWDFVEGYFHQFFLTKKESPLLTQETQTQLLQQFHRNGTDLLDMQMHALLHQPHCGVPDGSDTSISPGRCKWNKHTLTYRIINYPHDMKPSAVKDSIYNAVSIWSNVTPLIFQQVQNGDADIKVSFWQWAHEDGWPFDGPGGILGHAFLPNSGNPGVVHFDKNEHWSASDTGYNLFLVATHEIGHSLGLQHSGNQSSIMYPTYWYHDPRTFQLSADDIQRIQHLYGEKCSSDIP

SEQ ID NO: 49477 - protein, 261 aa, Homo sapiens; identical to SEQ ID NO: 49476
  Payload ID: 9906
  Gene Symbol: MMP26
  Gene Name: matrix metallopeptidase 26
  Uniprot ID: Q9NRE1
  ENSP ID: ENSP00000369753

SEQ ID NO: 49478 - protein, 513 aa, Homo sapiens
  Payload ID: 9907
  Gene Symbol: MMP27
  Gene Name: matrix metallopeptidase 27
  Uniprot ID: Q9H306
  ENSP ID: ENSP00000260229
MKRLLLLFLFFITFSSAFPLVRMTENEENMQLAQAYLNQFYSLEIEGNHLVQSKNRSLIDDKIREMQAFFGLTVTGKLDSNTLEIMKTPRCGVPDVGQYGYTLPGWRKYNLTYRIINYTPDMARAAVDEAIQEGLEVWSKVTPLKFTKISKGIADIMIAFRTRVHGRCPRYFDGPLGVLGHAFPPGPGLGGDTHFDEDENWTKDGAGFNLFLVAAHEFGHALGLSHSNDQTALMFPNYVSLDPRKYPLSQDDINGIQSIYGGLPKEPAKPKEPTIPHACDPDLTFDAITTFRREVMFFKGRHLWRIYYDITDVEFELIASFWPSLPADLQAAYENPRDKILVFKDENFWMIRGYAVLPDYPKSIHTLGFPGRVKKIDAAVCDKTTRKTYFFVGIWCWRFDEMTQTMDKGFPQRVVKHFPGISIRVDAAFQYKGFFFFSRGSKQFEYDIKTKNITRIMRTNTWFQCKEPKNSSFGFDINKEKAHSGGIKILYHKSLSLFIFGIVHLLKNTSIYQ

SEQ ID NO: 49479 - protein, 520 aa, Homo sapiens
  Payload ID: 9908
  Gene Symbol: MMP28
  Gene Name: matrix metallopeptidase 28
  Uniprot ID: Q9H239
  ENSP ID: ENSP00000473853
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKGGRCWRFRGPKPVWGLPQLCRAGGLPRHPDAALFFPPLRRLILFKGARYYVLARGGLQVEPYYPRSLQDWGGIPEEVSGALPRPDGSIIFFRDDRYWRLDQAKLQATTSGRWATELPWMGCWHANSGSALF

SEQ ID NO: 49480 - protein, 393 aa, Homo sapiens
  Payload ID: 9908
  Gene Symbol: MMP28
  Gene Name: matrix metallopeptidase 28
  ENSP ID: ENSP00000479124
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKVQSV

SEQ ID NO: 49481 - protein, 510 aa, Homo sapiens
  Payload ID: 9908
  Gene Symbol: MMP28
  Gene Name: matrix metallopeptidase 28
  ENSP ID: ENSP00000481051
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVGSHFWEVAADGNVSEPRPLQERWVGLPPNIEAAAVSLNDGDFYFFKGGRCWRFRGPKPVWGLPQLCRAGGLPRHPDAALFFPPLRRLILFKGARYYVLARGGLQVEPYYPRSLQDWGGIPEEVSGALPRPDGSIIFFRDDRYWRLDQAKLQATTSGRWATELPWMGCWHANSGSALF

SEQ ID NO: 49482 - protein, 89 aa, Homo sapiens
  Payload ID: 9908
  Gene Symbol: MMP28
  Gene Name: matrix metallopeptidase 28
  ENSP ID: ENSP00000482385
DFETWDSYSPQGRRPETQGPKYCHSSFDAITVDRQQQLYIFKGSHFWEVAADGNVSEPRPLQERWVGLPPNIEAAAVSLNDGDFYFFKA

SEQ ID NO: 49483 - protein, 393 aa, Homo sapiens; identical to SEQ ID NO: 49480
  Payload ID: 9908
  Gene Symbol: MMP28
  Gene Name: matrix metallopeptidase 28
  ENSP ID: ENSP00000483299

SEQ ID NO: 49484 - protein, 130 aa, Homo sapiens
  Payload ID: 9908
  Gene Symbol: MMP28
  Gene Name: matrix metallopeptidase 28
  Uniprot ID: Q9H239
  ENSP ID: ENSP00000483539
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGEHC

SEQ ID NO: 49485 - protein, 520 aa, Homo sapiens; identical to SEQ ID NO: 49479
  Payload ID: 9908
  Gene Symbol: MMP28
  Gene Name: matrix metallopeptidase 28
  Uniprot ID: Q9H239
  ENSP ID: ENSP00000484430

SEQ ID NO: 49486 - protein, 189 aa, Homo sapiens
  Payload ID: 9908
  Gene Symbol: MMP28
  Gene Name: matrix metallopeptidase 28
  ENSP ID: ENSP00000484562
KYGYLNEQVPKAPTSTRFSDAIRAFQWVSQLPVSGVLDRATLRQMTRPRCGVTDTNSYAAWAERISDLFARHRTKMRRKKRFAKQGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFET

SEQ ID NO: 49487 - protein, 88 aa, Homo sapiens
  Payload ID: 9908
  Gene Symbol: MMP28
  Gene Name: matrix metallopeptidase 28
  ENSP ID: ENSP00000487783
DFETWDSYSPQGRRPETQGPKYCHSSFDAITVDRQQQLYIFKGSHFWEVAADGNVSEPRPLQERWVGLPPNIEAAAVSLNDGDFYFFK

SEQ ID NO: 49488 - protein, 189 aa, Homo sapiens; identical to SEQ ID NO: 49486
  Payload ID: 9908
  Gene Symbol: MMP28
  Gene Name: matrix metallopeptidase 28
  ENSP ID: ENSP00000487847

SEQ ID NO: 49489 - protein, 130 aa, Homo sapiens; identical to SEQ ID NO: 49484
  Payload ID: 9908
  Gene Symbol: MMP28
  Gene Name: matrix metallopeptidase 28
  Uniprot ID: Q9H239
  ENSP ID: ENSP00000488096

SEQ ID NO: 49490 - protein, 510 aa, Homo sapiens; identical to SEQ ID NO: 49481
  Payload ID: 9908
  Gene Symbol: MMP28
  Gene Name: matrix metallopeptidase 28
  ENSP ID: ENSP00000488159

SEQ ID NO: 49491 - protein, 477 aa, Homo sapiens
  Payload ID: 9909
  Gene Symbol: MMP3
  Gene Name: matrix metallopeptidase 3
  Uniprot ID: P08254
  ENSP ID: ENSP00000299855
MKSLPILLLLCVAVCSAYPLDGAARGEDTSMNLVQKYLENYYDLKKDVKQFVRRKDSGPVVKKIREMQKFLGLEVTGKLDSDTLEVMRKPRCGVPDVGHFRTFPGIPKWRKTHLTYRIVNYTPDLPKDAVDSAVEKALKVWEEVTPLTFSRLYEGEADIMISFAVREHGDFYPFDGPGNVLAHAYAPGPGINGDAHFDDDEQWTKDTTGTNLFLVAAHEIGHSLGLFHSANTEALMYPLYHSLTDLTRFRLSQDDINGIQSLYGPPPDSPETPLVPTEPVPPEPGTPANCDPALSFDAVSTLRGEILIFKDRHFWRKSLRKLEPELHLISSFWPSLPSGVDAAYEVTSKDLVFIFKGNQFWAIRGNEVRAGYPRGIHTLGFPPTVRKIDAAISDKEKNKTYFFVEDKYWRFDEKRNSMEPGFPKQIAEDFPGIDSKIDAVFEEFGFFYFFTGSSQLEFDPNAKKVTHTLKSNSWLNC

SEQ ID NO: 49492 - protein, 99 aa, Homo sapiens
  Payload ID: 9909
  Gene Symbol: MMP3
  Gene Name: matrix metallopeptidase 3
  ENSP ID: ENSP00000398346
  MOD_RES (1)..(1): Any amino acid
XNQFWAIRGNEVRAGYPRGIHTLGFPPTVRKIDAAISDKEKNKTYFFVEDKYWRFDEKRNSMEPGFPKQIAEDFPGIDSKIDAVFEEFDRAGTECCLHS

SEQ ID NO: 49493 - protein, 42 aa, Homo sapiens
  Payload ID: 9909
  Gene Symbol: MMP3
  Gene Name: matrix metallopeptidase 3
  ENSP ID: ENSP00000435255
MKSLPILLLLCVAVCSAYPLDGAAREISRKLLRPQKRCETVC

SEQ ID NO: 49494 - protein, 267 aa, Homo sapiens
  Payload ID: 9910
  Gene Symbol: MMP7
  Gene Name: matrix metallopeptidase 7
  Uniprot ID: P09237
  ENSP ID: ENSP00000260227
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 49495 - protein, 467 aa, Homo sapiens [sequence omitted]

SEQ ID NO: 49496 - protein, 344 aa, Homo sapiens
  Payload ID: 9911
  Gene Symbol: MMP8
  Gene Name: matrix metallopeptidase 8
  ENSP ID: ENSP00000401004
  MOD_RES (1)..(1): Any amino acid
XKEKNTKTVQDYLEKFYQLPSNQYQSTRKNGTNVIVEKLKEMQRFFGLNVTGKPNEETLDMMKKPRCGVPDSGGFMLTPGNPKWERTNLTYRIRNYTPQLSEAEVERAIKDAFELWSVASPLIFTRISQGEADINIAFYQRDHGDNSPFDGPNGILAHAFQPGQGIGGDAHFDAEETWTNTSANYNLFLVAAHEFGHSLGLAHSSDPGALMYPNYAFRETSNYSLPQDDIDGIQAIYGLSSNPIQPTGPSTPKPCDPSLTFDAITTLRGEILFFKDRYFWRRHPQLQRVEMNFISLFWPSLPTGIQAAYEDFDRDLIFLFKDMITKDNSWSQVIPKAYQVPFQE

SEQ ID NO: 49497 - protein, 36 aa, Homo sapiens
  Payload ID: 9911
  Gene Symbol: MMP8
  Gene Name: matrix metallopeptidase 8
  ENSP ID: ENSP00000431431
MFSLKTLPFLLLLHVQISKAFPVSSKEKNTKTVQNK

SEQ ID NO: 49498 - protein, 43 aa, Homo sapiens
  Payload ID: 9911
  Gene Symbol: MMP8
  Gene Name: matrix metallopeptidase 8
  ENSP ID: ENSP00000431938
MFSLKTLPFLLLLHVQISKAFPVSSKEKNTKTVQRQKYLKSDK

SEQ ID NO: 49499 - protein, 56 aa, Homo sapiens
  Payload ID: 9911
  Gene Symbol: MMP8
  Gene Name: matrix metallopeptidase 8
  ENSP ID: ENSP00000433812
MFSLKTLPFLLLLHVQISKAFPVSSKEKNTKTVQHKAISEANQMQPPDLGLPSLQN

SEQ ID NO: 49500 - protein, 56 aa, Homo sapiens; identical to SEQ ID NO: 49499
  Payload ID: 9911
  Gene Symbol: MMP8
  Gene Name: matrix metallopeptidase 8
  ENSP ID: ENSP00000437173

SEQ ID NO: 49501 - protein, 707 aa, Homo sapiens
  Payload ID: 9912
  Gene Symbol: MMP9
  Gene Name: matrix metallopeptidase 9
  Uniprot ID: P14780
  ENSP ID: ENSP00000361405
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEERLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 49502 - protein, 2828 aa, Homo sapiens
  Payload ID: 9913
  Gene Symbol: MXRA5
  Gene Name: matrix-remodelling associated 5
  Uniprot ID: Q9NR99
  ENSP ID: ENSP00000217939
MPKRAHWGALSVVLILLWGHPRVALACPHPCACYVPSEVHCTFRSLASVPAGIAKHVERINLGFNSIQALSETSFAGLTKLELLMIHGNEIPSIPDGALRDLSSLQVFKFSYNKLRVITGQTLQGLSNLMRLHIDHNKIEFIHPQAFNGLTSLRLLHLEGNLLHQLHPSTFSTFTFLDYFRLSTIRHLYLAENMVRTLPASMLRNMPLLENLYLQGNPWTCDCEMRWFLEWDAKSRGILKCKKDKAYEGGQLCAMCFSPKKLYKHEIHKLKDMTCLKPSIESPLRQNRSRSIEEEQEQEEDGGSQLILEKFQLPQWSISLNMTDEHGNMVNLVCDIKKPMDVYKIHLNQTDPPDIDINATVALDFECPMTRENYEKLWKLIAYYSEVPVKLHRELMLSKDPRVSYQYRQDADEEALYYTGVRAQILAEPEWVMQPSIDIQLNRRQSTAKKVLLSYYTQYSQTISTKDTRQARGRSWVMIEPSGAVQRDQTVLEGGPCQLSCNVKASESPSIFWVLPDGSILKAPMDDPDSKFSILSSGWLRIKSMEPSDSGLYQCIAQVRDEMDRMVYRVLVQSPSTQPAEKDTVTIGKNPGESVTLPCNALAIPEAHLSWILPNRRIINDLANTSHVYMLPNGTLSIPKVQVSDSGYYRCVAVNQQGADHFTVGITVTKKGSGLPSKRGRRPGAKALSRVREDIVEDEGGSGMGDEENTSRRLLHPKDQEVFLKTKDDAINGDKKAKKGRRKLKLWKHSEKEPETNVAEGRRVFESRRRINMANKQINPERWADILAKVRGKNLPKGTEVPPLIKTTSPPSLSLEVTPPFPAISPPSASPVQTVTSAEESSADVPLLGEEEHVLGTISSASMGLEHNHNGVILVEPEVTSTPLEEVVDDLSEKTEEITSTEGDLKGTAAPTLISEPYEPSPTLHTLDTVYEKPTHEETATEGWSAADVGSSPEPTSSEYEPPLDAVSLAESEPMQYFDPDLETKSQPDEDKMKEDTFAHLTPTPTIWVNDSSTSQLFEDSTIGEPGVPGQSHLQGLTDNIHLVKSSLSTQDTLLIKKGMKEMSQTLQGGNMLEGDPTHSRSSESEGQESKSITLPDSTLGIMSSMSPVKKPAETTVGTLLDKDTTTATTTPRQKVAPSSTMSTHPSRRRPNGRRRLRPNKFRHRHKQTPPTTFAPSETFSTQPTQAPDIKISSQVESSLVPTAWVDNTVNTPKQLEMEKNAEPTSKGTPRRKHGKRPNKHRYTPSTVSSRASGSKPSPSPENKHRNIVTPSSETILLPRTVSLKTEGPYDSLDYMTTTRKIYSSYPKVQETLPVTYKPTSDGKEIKDDVATNVDKHKSDILVTGESITNAIPTSRSLVSTMGEFKEESSPVGFPGTPTWNPSRTAQPGRLQTGIPVTTSGENLTDPPLLKELEDVDFTSEFLSSLTVSTPFHQEEAGSSTTLSSIKVEVASSQAETTTLDQDHLETTVAILLSETRPQNHTPTAARMKEPASSSPSTILMSLGQTTTTKPALPSPRISQASRDSKENVFLNYVGNPETEATPVNNEGTQHMSGPNELSTPSSDQDAFNLSTKLELEKQVFGSRSLPRGPDSQRQDGRVHASHQLTRVPAKPILPTATVRLPEMSTQSASRYFVTSQSPRHWTNKPEITTYPSGALPENKQFTTPRLSSTTIPLPLHMSKPSIPSKFTDRRTDQFNGYSKVFGNNNIPEARNPVGKPPSPRIPHYSNGRLPFFTNKTLSFPQLGVTRRPQIPTSPAPVMRERKVIPGSYNRIHSHSTFHLDFGPPAPPLLHTPQTTGSPSTNLQNIPMVSSTQSSISFITSSVQSSGSFHQSSSKFFAGGPPASKFWSLGEKPQILTKSPQTVSVTAETDTVFPCEATGKPKPFVTWTKVSTGALMTPNTRIQRFEVLKNGTLVIRKVQVQDRGQYMCTASNLHGLDRMVVLLSVTVQQPQILASHYQDVTVYLGDTIAMECLAKGTPAPQISWIFPDRRVWQTVSPVEGRITLHENRTLSIKEASFSDRGVYKCVASNAAGADSLAIRLHVAALPPVIHQEKLENISLPPGLSIHIHCTAKAAPLPSVRWVLGDGTQIRPSQFLHGNLFVFPNGTLYIRNLAPKDSGRYECVAANLVGSARRTVQLNVQRAAANARITGTSPRRTDVRYGGTLKLDCSASGDPWPRILWRLPSKRMIDALFSFDSRIKVFANGTLVVKSVTDKDAGDYLCVARNKVGDDYVVLKVDVVMKPAKIEHKEENDHKVFYGGDLKVDCVATGLPNPEISWSLPDGSLVNSFMQSDDSGGRTKRYVVFNNGTLYFNEVGMREEGDYTCFAENQVGKDEMRVRVKVVTAPATIRNKTYLAVQVPYGDVVTVACEAKGEPMPKVTWLSPTNKVIPTSSEKYQIYQDGTLLIQKAQRSDSGNYTCLVRNSAGEDRKTVWIHVNVQPPKINGNPNPITTVREIAAGGSRKLIDCKAEGIPTPRVLWAFPEGVVLPAPYYGNRITVHGNGSLDIRSLRKSDSVQLVCMARNEGGEARLILQLTVLEPMEKPIFHDPISEKITAMAGHTISLNCSAAGTPTPSLVWVLPNGTDLQSGQQLQRFYHKADGMLHISGLSSVDAGAYRCVARNAAGHTERLVSLKVGLKPEANKQYHNLVSIINGETLKLPCTPPGAGQGRFSWTLPNGMHLEGPQTLGRVSLLDNGTLTVREASVFDRGTYVCRMETEYGPSVTSIPVIVIAYPPRITSEPTPVIYTRPGNTVKLNCMAMGIPKADITWELPDKSHLKAGVQARLYGNRFLHPQGSLTIQHATQRDAGFYKCMAKNILGSDSKTTYIHVF

SEQ ID NO: 49503 - protein, 204 aa, Homo sapiens
  Payload ID: 9914
  Gene Symbol: MXRA7
  Gene Name: matrix-remodelling associated 7
  Uniprot ID: P84157
  ENSP ID: ENSP00000348050
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRVQKEQLAAIFKLMKDNKETFGEMSDGDVQEQLRLYDM

SEQ ID NO: 49504 - protein, 177 aa, Homo sapiens
  Payload ID: 9914
  Gene Symbol: MXRA7
  Gene Name: matrix-remodelling associated 7
  Uniprot ID: P84157
  ENSP ID: ENSP00000364176
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRIELTSDLTSL

SEQ ID NO: 49505 - protein, 170 aa, Homo sapiens
  Payload ID: 9914
  Gene Symbol: MXRA7
  Gene Name: matrix-remodelling associated 7
  Uniprot ID: P84157
  ENSP ID: ENSP00000391466
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRTEE

SEQ ID NO: 49506 - protein, 213 aa, Homo sapiens
  Payload ID: 9914
  Gene Symbol: MXRA7
  Gene Name: matrix-remodelling associated 7
  ENSP ID: ENSP00000465103
MDTERVGDGKQHRRKQSQRLRWPCCLALVPDRHPSQLSSCTLCLLAAASQWESWAHFSKWHTEASTGTHLGKAKAEGLGCTVKNTPQLSICEPSHFGPSFVHSPHLLVDHDHRAGAATGRGQAGPSRASSVSPTFCPPTTSHHPVCAKGTDPVLVLQEEEQDLDGEKGPSSEGPEEEDGEGFSFKYSPGKLRGNQYKKMMTKEELEEEQRTEE

SEQ ID NO: 49507 - protein, 15 aa, Homo sapiens
  Payload ID: 9914
  Gene Symbol: MXRA7
  Gene Name: matrix-remodelling associated 7
  ENSP ID: ENSP00000466376
MMTKEELEEEQRTEE

SEQ ID NO: 49508 - protein, 22 aa, Homo sapiens
  Payload ID: 9914
  Gene Symbol: MXRA7
  Gene Name: matrix-remodelling associated 7
  ENSP ID: ENSP00000467510
MMTKEELEEEQRIELTSDLTSL

SEQ ID NO: 49509 - protein, 15 aa, Homo sapiens
  Payload ID: 9914
  Gene Symbol: MXRA7
  Gene Name: matrix-remodelling associated 7
  ENSP ID: ENSP00000468020
MMTKEELEEEQRTEE

SEQ ID NO: 49510 - protein, 442 aa, Homo sapiens
  Payload ID: 9915
  Gene Symbol: MXRA8
  Gene Name: matrix-remodelling associated 8
  Uniprot ID: Q9BRK3
  ENSP ID: ENSP00000307887
MALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 49511 - protein, 341 aa, Homo sapiens
  Payload ID: 9915
  Gene Symbol: MXRA8
  Gene Name: matrix-remodelling associated 8
  Uniprot ID: Q9BRK3
  ENSP ID: ENSP00000344998
MALPSRILLWKLVLLQSSAVLLHSAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 49512 - protein, 450 aa, Homo sapiens
  Payload ID: 9915
  Gene Symbol: MXRA8
  Gene Name: matrix-remodelling associated 8
  Uniprot ID: Q9BRK3
  ENSP ID: ENSP00000399229
MALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLASSPPTDYKNNILKERAELAHSPLPAKYIDLDKDPSGLCPLGA

SEQ ID NO: 49513 - protein, 433 aa, Homo sapiens
  Payload ID: 9915
  Gene Symbol: MXRA8
  Gene Name: matrix-remodelling associated 8
  Uniprot ID: Q9BRK3
  ENSP ID: ENSP00000436135
MIRCAATGSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 49514 - protein, 107 aa, Homo sapiens
  Payload ID: 9916
  Gene Symbol: MTCP1
  Gene Name: mature T-cell proliferation 1
  Uniprot ID: P56278
  ENSP ID: ENSP00000355058
MAGEDVGAPPDHLWVHQEGIYRDEYQRTWVAVVEEETSFLRARVQQIQVPLGDAARPSHLLTSQLPLMWQLYPEERYMDNNSRLWQIQHHLMVRGVQELLLKLLPDD

SEQ ID NO: 49515 - protein, 107 aa, Homo sapiens; identical to SEQ ID NO: 49514
  Payload ID: 9916
  Gene Symbol: MTCP1
  Gene Name: mature T-cell proliferation 1
  Uniprot ID: P56278
  ENSP ID: ENSP00000358488

SEQ ID NO: 49516 - protein, 9 aa, Homo sapiens
  Payload ID: 9916
  Gene Symbol: MTCP1
  Gene Name: mature T-cell proliferation 1
  ENSP ID: ENSP00000427132
LLLKLLPDD

SEQ ID NO: 49517 - protein, 131 aa, Homo sapiens
  Payload ID: 9917
  Gene Symbol: MTURN
  Gene Name: maturin, neural progenitor differentiation regulator homolog (Xenopus)
  Uniprot ID: Q8N3F0
  ENSP ID: ENSP00000324204
MDFQQLADVAEKWCSNTPFELIATEETERRMDFYADPGVSFYVLCPDNGCGDNFHVWSESEDCLPFLQLAQDYISSCGKKTLHEVLEKVFKSFRPLLGLPDADDDAFEEYSADVEEEEPEADHPQMGVSQQ

SEQ ID NO: 49518 - protein, 98 aa, Homo sapiens
  Payload ID: 9917
  Gene Symbol: MTURN
  Gene Name: maturin, neural progenitor differentiation regulator homolog (Xenopus)
  Uniprot ID: Q8N3F0
  ENSP ID: ENSP00000324755
MATHCPLYCVGADLMMNRAGEHVWSESEDCLPFLQLAQDYISSCGKKTLHEVLEKVFKSFRPLLGLPDADDDAFEEYSADVEEEEPEADHPQMGVSQQ

SEQ ID NO: 49519 - protein, 90 aa, Homo sapiens
  Payload ID: 9917
  Gene Symbol: MTURN
  Gene Name: maturin, neural progenitor differentiation regulator homolog (Xenopus)
  Uniprot ID: Q8N3F0
  ENSP ID: ENSP00000386490
MDFQQLADVAEKWCSNTPFELIATEETERRMDFYADPGVSFYVLCPDNGCGDNFLLGLPDADDDAFEEYSADVEEEEPEADHPQMGVSQQ

SEQ ID NO: 49520 - protein, 76 aa, Homo sapiens
  Payload ID: 9917
  Gene Symbol: MTURN
  Gene Name: maturin, neural progenitor differentiation regulator homolog (Xenopus)
  ENSP ID: ENSP00000415658
MIPWVEWNFLQVLEALMDKMPTSGVFLAGPLESVPGQHVWSESEDCLPFLQLAQDYISSCGKKTLHEVLEKVFKSF

SEQ ID NO: 49521 - protein, 613 aa, Homo sapiens
  Payload ID: 9918
  Gene Symbol: MAU2
  Gene Name: MAU2 sister chromatid cohesion factor
  Uniprot ID: Q9Y6X3
  ENSP ID: ENSP00000262815
MAAQAAAAAQAAAAQAAQAEAADSWYLALLGFAEHFRTSSPPKIRLCVHCLQAVFPFKPPQRIEARTHLQLGSVLYHHTKNSEQARSHLEKAWLISQQIPQFEDVKFEAASLLSELYCQENSVDAAKPLLRKAIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCLKQLQQCIQTISTLHDDEILPSNPADLFHWLPKEHMCVLVYLVTVMHSMQAGYLEKAQKYTDKALMQLEKLKMLDCSPILSSFQVILLEHIIMCRLVTGHKATALQEISQVCQLCQQSPRLFSNHAAQLHTLLGLYCVSVNCMDNAEAQFTTALRLTNHQELWAFIVTNLASVYIREGNRHQEVLYSLLERINPDHSFPVSSHCLRAAAFYVRGLFSFFQGRYNEAKRFLRETLKMSNAEDLNRLTACSLVLLGHIFYVLGNHRESNNMVVPAMQLASKIPDMSVQLWSSALLRDLNKACGNAMDAHEAAQMHQNFSQQLLQDHIEACSLPEHNLITWTDGPPPVQFQAQNGPNTSLASLL

SEQ ID NO: 49522 - protein, 183 aa, Homo sapiens
  Payload ID: 9918
  Gene Symbol: MAU2
  Gene Name: MAU2 sister chromatid cohesion factor
  ENSP ID: ENSP00000477034
KIRLCVHCLQAVFPFKPPQRIEARTHLQLGSVLYHHTKNSEQARSHLEKANSVDAAKPLLRKAIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCL

SEQ ID NO: 49523 - protein, 235 aa, Homo sapiens
  Payload ID: 9918
  Gene Symbol: MAU2
  Gene Name: MAU2 sister chromatid cohesion factor
  ENSP ID: ENSP00000477436
AIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCLKQLQQCIQTISTLHDDEILPSNPADLFHWLPKEHMCVLVYLVTVMHSMQAGYLEKAQKYTDKALMQLEKLKSKSVLDCSPILSSFQVILLEHIIMCRLVTGHKATALQEISQVC

SEQ ID NO: 49524 - protein, 221 aa, Homo sapiens
  Payload ID: 9919
  Gene Symbol: MXD1
  Gene Name: MAX dimerization protein 1
  Uniprot ID: Q05195
  ENSP ID: ENSP00000264444
MAAAVRMNIQMLLEAADYLERREREAEHGYASMLPYNNKDRDALKRRNKSKKNNSSSRSTHNEMEKNRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQDSHKACLGL

SEQ ID NO: 49525 - protein, 73 aa, Homo sapiens
  Payload ID: 9919
  Gene Symbol: MXD1
  Gene Name: MAX dimerization protein 1
  ENSP ID: ENSP00000386523
MLPYNNKDRDALKRRNKSKKNNSSSRRAHLRLCLEKLKGLVPLGPESSRHTTLSLLTKAKLHIKDKYPQHWRC

SEQ ID NO: 49526 - protein, 181 aa, Homo sapiens
  Payload ID: 9919
  Gene Symbol: MXD1
  Gene Name: MAX dimerization protein 1
  ENSP ID: ENSP00000410672
MLPYNNKDRDALKRRNKSKKNNSSSRSTHNEMEKNRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQD

SEQ ID NO: 49527 - protein, 211 aa, Homo sapiens
  Payload ID: 9919
  Gene Symbol: MXD1
  Gene Name: MAX dimerization protein 1
  Uniprot ID: Q05195
  ENSP ID: ENSP00000443935
MAAAVRMNIQMLLEAADYLERREREAEHGYASMLPYNNKDRDALKRRNKSKKNNSSSRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQDSHKACLGL

SEQ ID NO: 49528 - protein, 388 aa, Homo sapiens
  Payload ID: 9920
  Gene Symbol: MXD3
  Gene Name: MAX dimerization protein 3
  Uniprot ID: Q9BW11
  ENSP ID: ENSP00000389716
MEPLASNIQVLLQAAEFLERREREAEHGYASLCPHRSPGPIHRRKKRPPQAPGAQDSGRSVHNELEKRRRAQLKRCLERLKQQMPLGADCARYTTLSLLRRARMHIQKLEDQEQRARQLKERLRSKQQSLQRQLEQLRGLAGAAERERLRADSLDSSGLSSERSDSDQGECPEAEGLCGPRGEPGLLTGPLPAQRSWRWMWRAWCLGVRPSCCGASSPARSTATRTAAAPGYDVPHPGRASALYSCQAHLPGRSPPQAFRAARSHLLEWTKRTLVWEQVLPKHPAAGCQAGPLEGKGQDSSGPPWTPAGQAAWARAQAFGSAAPKGTGSLLGLFPSWTRPPAFASHKLYSIFIKSLFHNFPSIVLPNENGGTPNHRPTGRGNNISSHH

SEQ ID NO: 49529 - protein, 206 aa, Homo sapiens
  Payload ID: 9920
  Gene Symbol: MXD3
  Gene Name: MAX dimerization protein 3
  Uniprot ID: Q9BW11
  ENSP ID: ENSP00000401867
MEPLASNIQVLLQAAEFLERREREAEHGYASLCPHRSPGPIHRRKKRPPQAPGAQDSGRSVHNELEKRRRAQLKRCLERLKQQMPLGADCARYTTLSLLRRARMHIQKLEDQEQRARQLKERLRSKQQSLQRQLEQLRGLAGAAERERLRADSLDSSGLSSERSDSDQEELEVDVESLVFGGEAELLRGFVAGQEHSYSHGGGAWL

SEQ ID NO: 49530 - protein, 193 aa, Homo sapiens
  Payload ID: 9920
  Gene Symbol: MXD3
  Gene Name: MAX dimerization protein 3
  Uniprot ID: Q9BW11
  ENSP ID: ENSP00000416921
MEPLASNIQVLLQAAEFLERREREAEHGYASLCPHRSPGPIHRRKKRPPQAPGAQDSGRSVHNELEKRRRAQLKRCLERLKQQMPLGADCARYTTLSLLRRARMHIQKLEDQEQRARQLKERLRSKQQSLQRQLEQLRGLAGAAERERLRADSLDSSGLSSERSDSDQVLPNENGGTPNHRPTGRGNNISSHH

SEQ ID NO: 49531 - protein, 206 aa, Homo sapiens; identical to SEQ ID NO: 49529
  Payload ID: 9920
  Gene Symbol: MXD3
  Gene Name: MAX dimerization protein 3
  Uniprot ID: Q9BW11
  ENSP ID: ENSP00000421463

SEQ ID NO: 49532 - protein, 124 aa, Homo sapiens
  Payload ID: 9920
  Gene Symbol: MXD3
  Gene Name: MAX dimerization protein 3
  ENSP ID: ENSP00000425029
MEPLASNIQVLLQAAEFLERREREAEHGYASLCPHRSPGPIHRRKKRPPQAPGAQDSGRRAQLKRCLERLKQQMPLGADCARYTTLSLLRRARMHIQKLEDQEQRARQLKERLRSKQQSLQRQL

SEQ ID NO: 49533 - protein, 74 aa, Homo sapiens
  Payload ID: 9920
  Gene Symbol: MXD3
  Gene Name: MAX dimerization protein 3
  ENSP ID: ENSP00000427104
MPLGADCARYTTLSLLRRARMHIQKLEDQEQRARQLKERLRSKQQSLQRQLEQLRGLAGAAERERLRADSLDSS

SEQ ID NO: 49534 - protein, 209 aa, Homo sapiens
  Payload ID: 9921
  Gene Symbol: MXD4
  Gene Name: MAX dimerization protein 4
  Uniprot ID: Q14582
  ENSP ID: ENSP00000337889
MELNSLLILLEAAEYLERRDREAEHGYASVLPFDGDFAREKTKAAGLVRKAPNNRSSHNELEKHRRAKLRLYLEQLKQLVPLGPDSTRHTTLSLLKRAKVHIKKLEEQDRRALSIKEQLQQEHRFLKRRLEQLSVQSVERVRTDSTGSAVSTDDSEQEVDIEGMEFGPGELDSVGSSSDADDHYSLQSGTGGDSGFGPHCRRLGRPALS

SEQ ID NO: 49535 - protein, 107 aa, Homo sapiens
  Payload ID: 9921
  Gene Symbol: MXD4
  Gene Name: MAX dimerization protein 4
  ENSP ID: ENSP00000421209
MELNSLLILLEAAEYLERRDREAEHGYASVLPFDGDFAREKTKAAGLVRKAPNNSGILGGPGALAGLWGPAWTRKVAWSWERGPPASLSSRQMLWHTLWCWELCARV

SEQ ID NO: 49536 - protein, 82 aa, Homo sapiens
  Payload ID: 9921
  Gene Symbol: MXD4
  Gene Name: MAX dimerization protein 4
  ENSP ID: ENSP00000422660
  MOD_RES (1)..(1): Any amino acid
XLPFDGDFAREKTKAAGLVRKAPNNRSSHNELEKHRCSVISKAVCSRTSPAPHPRDRIPGTQRLSHILHCSPRALTLPMRLG

SEQ ID NO: 49537 - protein, 228 aa, Homo sapiens
  Payload ID: 9922
  Gene Symbol: MXI1
  Gene Name: MAX interactor 1, dimerization protein
  Uniprot ID: P50539
  ENSP ID: ENSP00000239007
MERVKMINVQRLLEAAEFLERRERECEHGYASSFPSMPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 49538 - protein, 295 aa, Homo sapiens
  Payload ID: 9922
  Gene Symbol: MXI1
  Gene Name: MAX interactor 1, dimerization protein
  Uniprot ID: P50539
  ENSP ID: ENSP00000331152
MGKRGRPRKEARCEGAGLAPAAPPAVPPAVAAPQPPALPEDPAGAKPRCPFSDIFNTSENSMEKHINTFLQNVQILLEAASYLEQIEKENKKCEHGYASSFPSMPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 49539 - protein, 182 aa, Homo sapiens
  Payload ID: 9922
  Gene Symbol: MXI1
  Gene Name: MAX interactor 1, dimerization protein
  Uniprot ID: P50539
  ENSP ID: ENSP00000354606
MPSPRLQHSKPPRRLSRAQKHSSGSSNTSTANRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 49540 - protein, 192 aa, Homo sapiens
  Payload ID: 9922
  Gene Symbol: MXI1
  Gene Name: MAX interactor 1, dimerization protein
  Uniprot ID: P50539
  ENSP ID: ENSP00000358625
MPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 49541 - protein, 218 aa, Homo sapiens
  Payload ID: 9922
  Gene Symbol: MXI1
  Gene Name: MAX interactor 1, dimerization protein
  ENSP ID: ENSP00000376842
MERVKMINVQRLLEAAEFLERRERECEHGYASSFPSMPSPRLQHSKPPRRLSRAQKHSSGSSNTSTANRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 49542 - protein, 226 aa, Homo sapiens
  Payload ID: 9922
  Gene Symbol: MXI1
  Gene Name: MAX interactor 1, dimerization protein
  ENSP ID: ENSP00000398981
MGKRGRPRKEARCEGAGLAPAAPPAVPPAVAAPQPPALPEDPAGAKPRCPFSDIFNTSENSMEKHINTFLQNVQILLEAASYLEQIEKENKKCEHGYASSFPSMPSPRLQHSKPPRRLSRAQKHSSGSSNTSTANRRAHLRLCLERLKVLIPLGPDCTRHTTLGLLNKAKAHIKKLEEAERKSQHQLENLEREQRFLKWRLEQLQGPQEMERIRMDSIGSTISSDR

SEQ ID NO: 49543 - protein, 118 aa, Homo sapiens
  Payload ID: 9922
  Gene Symbol: MXI1
  Gene Name: MAX interactor 1, dimerization protein
  ENSP ID: ENSP00000407711
MPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEME

SEQ ID NO: 49544 - protein, 582 aa, Homo sapiens
  Payload ID: 9923
  Gene Symbol: MNT
  Gene Name: MAX network transcriptional repressor
  Uniprot ID: Q99583
  ENSP ID: ENSP00000174618
MSIETLLEAARFLEWQAQQQQRAREEQERLRLEQEREQEQKKANSLARLAHTLPVEEPRMEAPPLPLSPPAPPPAPPPPLATPAPLTVIPIPVVTNSPQPLPPPPPLPAAAQPLPLAPRQPALVGAPGLSIKEPAPLPSRPQVPTPAPLLPDSKATIPPNGSPKPLQPLPTPVLTIAPHPGVQPQLAPQQPPPPTLGTLKLAPAEEVKSSEQKKRPGGIGTREVHNKLEKNRRAHLKECFETLKRNIPNVDDKKTSNLSVLRTALRYIQSLKRKEKEYEHEMERLAREKIATQQRLAELKHELSQWMDVLEIDRVLRQTGQPEDDQASTSTASEGEDNIDEDMEEDRAGLGPPKLSHRPQPELLKSTLPPPSTTPAPLPPHPHPHPHSVALPPAHLPVQQQQPQQKTPLPAPPPPPAAPAQTLVPAPAHLVATAGGGSTVIAHTATTHASVIQTVNHVLQGPGGKHIAHIAPSAPSPAVQLAPATPPIGHITVHPATLNHVAHLGSQLPLYPQPVAVSHIAHTLSHQQVNGTAGLGPPATVMAKPAVGAQVVHHPQLVGQTVLNPVTMVTMPSFPVSTLKLA

SEQ ID NO: 49545 - protein, 33 aa, Homo sapiens
  Payload ID: 9923
  Gene Symbol: MNT
  Gene Name: MAX network transcriptional repressor
  ENSP ID: ENSP00000476269
MSIETLLEAARFLEWQAQQQQRARVPEEEGEGI

SEQ ID NO: 49546 - protein, 410 aa, Homo sapiens
  Payload ID: 9924
  Gene Symbol: MBTD1
  Gene Name: mbt domain containing 1
  Uniprot ID: Q05BQ5
  ENSP ID: ENSP00000365561
MGTCWGDISENVRVEVPNTDCSLPTKVFWIAGIVKLAGYNALLRYEGFENDSGLDFWCNICGSDIHPVGWCAASGKPLVPPRTIQHKYTNWKAFLVKRLTGAKTLPPDFSQKVSESMQYPFKPCMRVEVVDKRHLCRTRVAVVESVIGGRLRLVYEESEDRTDDFWCHMHSPLIHHIGWSRSIGHRFKRSDITKKQDGHFDTPPHLFAKVKEVDQSGEWFKEGMKLEAIDPLNLSTICVATIRKVLADGFLMIGIDGSEAADGSDWFCYHATSPSIFPVGFCEINMIELTPPRGYTKLPFKWFDYLRETGSIAAPVKLFNKDVPNHGFRVGMKLEAVDLMEPRLICVATVTRIIHRLLRIHFDGWEEEYDQWVDCESPDLYPVGWCQLTGYQLQPPASQCKLVYRKGVLL

SEQ ID NO: 49547 - protein, 169 aa, Homo sapiens
  Payload ID: 9924
  Gene Symbol: MBTD1
  Gene Name: mbt domain containing 1
  Uniprot ID: Q05BQ5
  ENSP ID: ENSP00000386072
MFDGYDSCSEDTSSSSSSEESEEEVAPLPSNLPIIKNNGQVYTYPDGKSGMATCEMCGMVGVRDAFYSKTKRFCSVSCSRSYSSNSKKASILARLQGKPPTKKAKVLQKQPLVAKLAAYAQYQATLQNQAKTKAAVSMEGFSWGNYINSNSFIAAPVTCFKHGRRVAPR

SEQ ID NO: 49548 - protein, 628 aa, Homo sapiens
  Payload ID: 9924
  Gene Symbol: MBTD1
  Gene Name: mbt domain containing 1
  Uniprot ID: Q05BQ5
  ENSP ID: ENSP00000403946
MFDGYDSCSEDTSSSSSSEESEEEVAPLPSNLPIIKNNGQVYTYPDGKSGMATCEMCGMVGVRDAFYSKTKRFCSVSCSRSYSSNSKKASILARLQGKPPTKKAKVLQKQPLVAKLAAYAQYQATLQNQAKTKAAVSMEGFSWGNYINSNSFIAAPVTCFKHAPMGTCWGDISENVRVEVPNTDCSLPTKVFWIAGIVKLAGYNALLRYEGFENDSGLDFWCNICGSDIHPVGWCAASGKPLVPPRTIQHKYTNWKAFLVKRLTGAKTLPPDFSQKVSESMQYPFKPCMRVEVVDKRHLCRTRVAVVESVIGGRLRLVYEESEDRTDDFWCHMHSPLIHHIGWSRSIGHRFKRSDITKKQDGHFDTPPHLFAKVKEVDQSGEWFKEGMKLEAIDPLNLSTICVATIRKVLADGFLMIGIDGSEAADGSDWFCYHATSPSIFPVGFCEINMIELTPPRGYTKLPFKWFDYLRETGSIAAPVKLFNKDVPNHGFRVGMKLEAVDLMEPRLICVATVTRIIHRLLRIHFDGWEEEYDQWVDCESPDLYPVGWCQLTGYQLQPPASQSSRENQSASSKQKKKAKSQQYKGHKKMTTLQLKEELLDGEDYNFLQGASDQESNGSANFYIKQEP

SEQ ID NO: 49549 - protein, 89 aa, Homo sapiens
  Payload ID: 9924
  Gene Symbol: MBTD1
  Gene Name: mbt domain containing 1
  ENSP ID: ENSP00000467622
DVPNHGFRVGMKLEAVDLMEPRLICVATVTRIIHRLLRIHFDGWEEEYDQWVDCESPDLYPVGWCQLTGYQLQPPASQCKLVYRKGVLL

SEQ ID NO: 49550 - protein, 628 aa, Homo sapiens; identical to SEQ ID NO: 49548
  Payload ID: 9924
  Gene Symbol: MBTD1
  Gene Name: mbt domain containing 1
  Uniprot ID: Q05BQ5
  ENSP ID: ENSP00000468304

SEQ ID NO: 49551 - protein, 941 aa, Homo sapiens
  Payload ID: 9925
  Gene Symbol: MCF2
  Gene Name: MCF.2 cell line derived transforming sequence
  Uniprot ID: P10911
  ENSP ID: ENSP00000342204
MAEANPRRGKMRFRRNAASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQVGVGYSFFQACKLFSKGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 49552 - protein, 860 aa, Homo sapiens
  Payload ID: 9925
  Gene Symbol: MCF2
  Gene Name: MCF.2 cell line derived transforming sequence
  Uniprot ID: P10911
  ENSP ID: ENSP00000359605
MAEANPRRGKMRFRRNAASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEDLCRRWLSYIDEATMSNGK

SEQ ID NO: 49553 - protein, 925 aa, Homo sapiens
  Payload ID: 9925
  Gene Symbol: MCF2
  Gene Name: MCF.2 cell line derived transforming sequence
  Uniprot ID: P10911
  ENSP ID: ENSP00000359608
MAEANPRRGKMRFRRNAASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 49554 - protein, 985 aa, Homo sapiens
  Payload ID: 9925
  Gene Symbol: MCF2
  Gene Name: MCF.2 cell line derived transforming sequence
  Uniprot ID: P10911
  ENSP ID: ENSP00000397055
MQDIAFLSGGRGKDNAWIITFPENCNFRCIPEEVIAKVLTYLTSIARQNGSDSRFTIILDRRLDTWSSLKISLQKISASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 49555 - protein, 429 aa, Homo sapiens
  Payload ID: 9925
  Gene Symbol: MCF2
  Gene Name: MCF.2 cell line derived transforming sequence
  ENSP ID: ENSP00000403271
  MOD_RES (1)..(1): Any amino acid
XHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 49556 - protein, 528 aa, Homo sapiens
  Payload ID: 9925
  Gene Symbol: MCF2
  Gene Name: MCF.2 cell line derived transforming sequence
  ENSP ID: ENSP00000405848
VQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 49557 - protein, 985 aa, Homo sapiens; identical to SEQ ID NO: 49554
  Payload ID: 9925
  Gene Symbol: MCF2
  Gene Name: MCF.2 cell line derived transforming sequence
  Uniprot ID: P10911
  ENSP ID: ENSP00000427745

SEQ ID NO: 49558 - protein, 1001 aa, Homo sapiens
  Payload ID: 9925
  Gene Symbol: MCF2
  Gene Name: MCF.2 cell line derived transforming sequence
  Uniprot ID: P10911
  ENSP ID: ENSP00000430276
MQDIAFLSGGRGKDNAWIITFPENCNFRCIPEEVIAKVLTYLTSIARQNGSDSRFTIILDRRLDTWSSLKISLQKISASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQVGVGYSFFQACKLFSKGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 49559 - protein, 821 aa, Homo sapiens
  Payload ID: 9925
  Gene Symbol: MCF2
  Gene Name: MCF.2 cell line derived transforming sequence
  Uniprot ID: P10911
  ENSP ID: ENSP00000438155
MAEANPRRGKMRFRRNAASFPGNLHLVLVLRPTSFLQRTFTDIGFWFSQEDFMLKLPAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEDLCRRWLSYIDEATMSNGK

SEQ ID NO: 49560 - protein, 296 aa, Homo sapiens
  Payload ID: 9926
  Gene Symbol: MCF2L
  Gene Name: MCF.2 cell line derived transforming sequence-like
  ENSP ID: ENSP00000261963
  MOD_RES (1)..(1): Any amino acid
XHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 49561 - protein, 984 aa, Homo sapiens
  Payload ID: 9926
  Gene Symbol: MCF2L
  Gene Name: MCF.2 cell line derived transforming sequence-like
  Uniprot ID: O15068
  ENSP ID: ENSP00000364747
MTVRRLSLLCRDLWALWLLLKAGADEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKEP

SEQ ID NO: 49562 - protein, 1123 aa, Homo sapiens
  Payload ID: 9926
  Gene Symbol: MCF2L
  Gene Name: MCF.2 cell line derived transforming sequence-like
  Uniprot ID: O15068
  ENSP ID: ENSP00000364754
MTVRRLSLLCRDLWALWLLLKAGADEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 49563 - protein, 1137 aa, Homo sapiens
  Payload ID: 9926
  Gene Symbol: MCF2L
  Gene Name: MCF.2 cell line derived transforming sequence-like
  Uniprot ID: O15068
  ENSP ID: ENSP00000364758
MFDCWRFILCKRPGSNSYSSPQRPNEAKKEETDHQIDVSDVIRLVQDTPEATAMATDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSGKAHVPRAHP

SEQ ID NO: 49564 - protein, 793 aa, Homo sapiens
  Payload ID: 9926
  Gene Symbol: MCF2L
  Gene Name: MCF.2 cell line derived transforming sequence-like
  ENSP ID: ENSP00000380212
  MOD_RES (1)..(1): Any amino acid
XSQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKASPTSPDKKAKRHEVKSDPTPFGVRGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSGKAHVPRAHP

SEQ ID NO: 49565 - protein, 86 aa, Homo sapiens
  Payload ID: 9926
  Gene Symbol: MCF2L
  Gene Name: MCF.2 cell line derived transforming sequence-like
  ENSP ID: ENSP00000380216
MWLSQRVLPPLPFPADAWEPSEVLGIFSQHRSHATTSESLTWTSTGTSDARTGVILQDAGIGFILVIDRRRDKWTSVKASVLRIAN

SEQ ID NO: 49566 - protein, 136 aa, Homo sapiens
  Payload ID: 9926
  Gene Symbol: MCF2L
  Gene Name: MCF.2 cell line derived transforming sequence-like
  ENSP ID: ENSP00000380219
MTVRRLSLLCRDLWALWLLLKAGADEIMHQDIVPLCAADIQDQLKKRFAYLSGGRGQDGSPVITFPDYPAFSEIPDKEFQNVMTYLTSIPSGGQESSIRPVSCRLTWEGCRGGLSSDVLVPASRKMLRMSASHQTV

SEQ ID NO: 49567 - protein, 1096 aa, Homo sapiens
  Payload ID: 9926
  Gene Symbol: MCF2L
  Gene Name: MCF.2 cell line derived transforming sequence-like
  Uniprot ID: O15068
  ENSP ID: ENSP00000380225
MPLRGGAGPSPASHGPTHGPSDPRTCLPGRGAGGMRPHGRGALGCCGLCSFYTCHGAAGDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLW

SEQ ID NO: 49568 - protein, 64 aa, Homo sapiens
  Payload ID: 9926
  Gene Symbol: MCF2L
  Gene Name: MCF.2 cell line derived transforming sequence-like
  ENSP ID: ENSP00000380230
MFDCWRFILCKRPGSNSYSSPQRPNEAKKEETDHQIDVSDVIRLVQDTPEATAMATEVSASRPQ

SEQ ID NO: 49569 - protein, 136 aa, Homo sapiens
  Payload ID: 9926
  Gene Symbol: MCF2L
  Gene Name: MCF.2 cell line derived transforming sequence-like
  ENSP ID: ENSP00000386551
MHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVI

SEQ ID NO: 49570 - protein, 336 aa, Homo sapiens
  Payload ID: 9926
  Gene Symbol: MCF2L
  Gene Name: MCF.2 cell line derived transforming sequence-like
  ENSP ID: ENSP00000392953
  MOD_RES (1)..(1): Any amino acid
XENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKDDTVTSSASESSALSRKRFTLQGFANLKGQKASPTSPDKKAKRHEVKSDPTPFGVRGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 49571 - protein, 97 aa, Homo sapiens
  Payload ID: 9926
  Gene Symbol: MCF2L
  Gene Name: MCF.2 cell line derived transforming sequence-like
  ENSP ID: ENSP00000395707
MGDGKAVRISVAEMKSYYLYSEWCSWLLSVAEDEIMHQDIVPLCAADIQDQLKKRFAYLSGGRGQDGSPVITFPDYPAFSEIPDKEFQNVMTYLTSI

SEQ ID NO: 49572 - protein, 87 aa, Homo sapiens
  Payload ID: 9926
  Gene Symbol: MCF2L
  Gene Name: MCF.2 cell line derived transforming sequence-like
  ENSP ID: ENSP00000395978
  MOD_RES (1)..(1): Any amino acid
XSAPLTKPPEKGKGWSKTSHSLEAPEDDGGWSSAEEQINSSDAEEDGGLGPKKLVPTQPPVEPTRGCTFLRGDSPHPPTLYVIECCH

SEQ ID NO: 49573 - protein, 1067 aa, Homo sapiens
  Payload ID: 9926
  Gene Symbol: MCF2L
  Gene Name: MCF.2 cell line derived transforming sequence-like
  Uniprot ID: O15068
  ENSP ID: ENSP00000397285
MAEKGASRGTLRRLWSLPRRRRGTAGRSRPDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLW

SEQ ID NO: 49574 - protein, 66 aa, Homo sapiens
  Payload ID: 9926
  Gene Symbol: MCF2L
  Gene Name: MCF.2 cell line derived transforming sequence-like
  ENSP ID: ENSP00000398383
MFDCWRFILCKRPGSNSYSSPQRPNEAKKEETDHQIDVSDVIRLVQDTPEATAMATAPRRSQSPGL

SEQ ID NO: 49575 - protein, 189 aa, Homo sapiens
  Payload ID: 9926
  Gene Symbol: MCF2L
  Gene Name: MCF.2 cell line derived transforming sequence-like
  ENSP ID: ENSP00000404422
  MOD_RES (1)..(1): Any amino acid
XKKLEERKTDPLSLEGYVSSAPLTKPPEKGKASPTSPDKKAKRHEVKSDPTPFGVRGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQ

SEQ ID NO: 49576 - protein, 213 aa, Homo sapiens
  Payload ID: 9926
  Gene Symbol: MCF2L
  Gene Name: MCF.2 cell line derived transforming sequence-like
  ENSP ID: ENSP00000405996
TSTGTSDARTGVILQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKVHGGCSGWKLWGAPVSQKLRGAPVGSCGGSFVPAGVCVSST

SEQ ID NO: 49577 - protein, 317 aa, Homo sapiens
  Payload ID: 9926
  Gene Symbol: MCF2L
  Gene Name: MCF.2 cell line derived transforming sequence-like
  ENSP ID: ENSP00000407392
  MOD_RES (1)..(1): Any amino acid
XLGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKDDTVTSSASESSALSRKRFTLQGFANLKASPTSPDKKAKRHEVKSDPTPFGVRGWSKTSHSLEAPEDDGGWSSAEEQINSSDAEEDGGLGPKKLVPGKYTVVA

SEQ ID NO: 49578 - protein, 151 aa, Homo sapiens
  Payload ID: 9926
  Gene Symbol: MCF2L
  Gene Name: MCF.2 cell line derived transforming sequence-like
  ENSP ID: ENSP00000411315
  MOD_RES (1)..(1): Any amino acid
XQAPTPEIKAAWVNEIRKVLTSQLQACREASQHRALEQSQSLPLPAPTSTSPSRGNSRNIKKLEERKTDPLSLEGYVSSAPLTKPPEKGKDDTVTSSASESSALSRKRFTLQGFANLKGQKGWSKTSHSLEAPEDDGGWSSAEEQINSSDA

SEQ ID NO: 49579 - protein, 1125 aa, Homo sapiens
  Payload ID: 9926
  Gene Symbol: MCF2L
  Gene Name: MCF.2 cell line derived transforming sequence-like
  Uniprot ID: O15068
  ENSP ID: ENSP00000440374
MRFWLRTEEMALEEMVQRLNAVSKHTDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 49580 - protein, 93 aa, Homo sapiens
  Payload ID: 9926
  Gene Symbol: MCF2L
  Gene Name: MCF.2 cell line derived transforming sequence-like
  ENSP ID: ENSP00000471913
SPVITFPDYPAFSEIPDKEFQNVMTYLTSIPSILFMESAASEHWGQVAEALPFLPPGSARTAVTTSPRGPLPAPSQNVFPRSFSVTAVEFNSY

SEQ ID NO: 49581 - protein, 69 aa, Homo sapiens
  Payload ID: 9926
  Gene Symbol: MCF2L
  Gene Name: MCF.2 cell line derived transforming sequence-like
  ENSP ID: ENSP00000473071
  MOD_RES (1)..(1): Any amino acid
XSEIPDKEFQNVMTYLTSIPSLQDAGIGFILVIDRRRDKWTSVKASVLRIALRARCTESEPLHPGGSGI

SEQ ID NO: 49582 - protein, 1114 aa, Homo sapiens
  Payload ID: 9927
  Gene Symbol: MCF2L2
  Gene Name: MCF.2 cell line derived transforming sequence-like 2
  Uniprot ID: Q86YR7
  ENSP ID: ENSP00000328118
MLSCLKEEMPPQELTRRLATVITHVDEIMQQEVRPLMAVEIIEQLHRQFAILSGGRGEDGAPIITFPEFSGFKHIPDEDFLNVMTYLTSIPSVEAASIGFIVVIDRRRDKWSSVKASLTRIAVAFPGNLQLIFILRPSRFIQRTFTDIGIKYYRNEFKTKVPIIMVNSVSDLHGYIDKSQLTRELGGTLEYRHGQWVNHRTAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTETELNSRGKEDDETKFEVKSEEIFESHHERGNPELEQQARLGDLSPRRRIIRDLLETEEIYIKEIKSIIDGYITPMDFIWLKHLIPDVLQNNKDFLFGNIRELYEFHNRTFLKELEKCAENPELLAHCFLKRKEDLQIYFKYHKNLPRARAIWQECQDCAYFGVCQRQLDHNLPLFKYLKGPSQRLIKYQMLLKGLLDFESPEDMEIDPGELGGSAKDGPKRTKDSAFSTELQQALAVIEDLIKSCELAVDLAAVTECPDDIGKLGKLLLHGPFSVWTIHKDRYKMKDLIRFKPSQRQIYLFERGIVFCKIRMEPGDQGLSPHYSFKKTMKLMTLSIRQLGRGSHRKFEIASRNGLEKYILQAASKEIRDCWFSEISKLLMEQQNNIKDQGNPQFEMSTSKGSGAGSGPWIKNMERATTSKEDPASSTGGIKGCSSREFSSMDTFEDCEGAEDMEKESSALSLAGLFQSDDSHETCSSKSAFLERGESSQGEKEERDEEETATRSTEEERAGASTGRLAPAGATAGFQARALRPRTSAQES

SEQ ID NO: 49583 - protein, 711 aa, Homo sapiens
  Payload ID: 9927
  Gene Symbol: MCF2L2
  Gene Name: MCF.2 cell line derived transforming sequence-like 2
  Uniprot ID: Q86YR7
  ENSP ID: ENSP00000388190
MLSCLKEEMPPQELTRRLATVITHVDEIMQQEVRPLMAVEIIEQLHRQFAILSGGRGEDGAPIITFPEFSGFKHIPDEDFLNVMTYLTSIPSVEAASIGFIVVIDRRRDKWSSVKASLTRIAVAFPGNLQLIFILRPSRFIQRTFTDIGIKYYRNEFKTKVPIIMVNSVSDLHGYIDKSQLTRELGGTLEYRHGQWVNHRTAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTETELNSRGKEDDETKFEVKSEEIFESHHERGNPELEQQARLGDLSPRRRIIRDLLETEEIYIKEIKSIIDGYITPMDFIWLKHLIPDVLQNNKDFLFGNIRELYEFHNRTFLKELEKCAENPELLAHCFLKRVSLYSQ

SEQ ID NO: 49584 - protein, 628 aa, Homo sapiens
  Payload ID: 9927
  Gene Symbol: MCF2L2
  Gene Name: MCF.2 cell line derived transforming sequence-like 2
  Uniprot ID: Q86YR7
  ENSP ID: ENSP00000414131
MLSCLKEEMPPQELTRRLATVITHVDEIMQQEVRPLMAVEIIEQLHRQFAILSGGRGEDGAPIITFPEFSGFKHIPDEDFLNVMTYLTSIPSVEAASIGFIVVIDRRRDKWSSVKASLTRIAVAFPGNLQLIFILRPSRFIQRTFTDIGIKYYRNEFKTKVPIIMVNSVSDLHGYIDKSQLTRELGGTLEYRHGQWVNHRTAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTETELNSRGKEDDETKFEVKSEEIFESHHERGNPELEQQARLGDLSPRRYSSQYFK

SEQ ID NO: 49585 - protein, 124 aa, Homo sapiens
  Payload ID: 9927
  Gene Symbol: MCF2L2
  Gene Name: MCF.2 cell line derived transforming sequence-like 2
  ENSP ID: ENSP00000417345
MQQEVRPLMAVEIIEQLHRQFAILSGGRGEDGAPIITFPEFSGFKHIPDEDFLNVMTYLTSIPSVEAASIGFIVVIDRRRDKWSSVKASLTRIAVAFPGNLQLIFILRPSRFIQRTFTDIGIKY

SEQ ID NO: 49586 - protein, 1074 aa, Homo sapiens
  Payload ID: 9927
  Gene Symbol: MCF2L2
  Gene Name: MCF.2 cell line derived transforming sequence-like 2
  Uniprot ID: Q86YR7
  ENSP ID: ENSP00000420070
MLSCLKEEMPPQELTRRLATVITHVDEIMQQEVRPLMAVEIIEQLHRQFAILSGGRGEDGAPIITFPEFSGFKHIPDEDFLNVMTYLTSIPSVEAASIGFIVVIDRRRDKWSSVKASLTRIAVAFPGNLQLIFILRPSRFIQRTFTDIGIKYYRNEFKTKVPIIMVNSVSDLHGYIDKSQLTRELGGTLEYRHGQWVNHRTAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTETELNSRGKEDDETKFEVKSEEIFESHHERGNPELEQQARLGDLSPRRRIIRDLLETEEIYIKEIKSIIDGYITPMDFIWLKHLIPDVLQNNKDFLFGNIRELYEFHNRTFLKELEKCAENPELLAHCFLKRKEDLQIYFKYHKNLPRARAIWQECQDCAYFGVCQRQLDHNLPLFKYLKGPSQRLIKYQMLLKGLLDFESPEDMEIDPGELGGSAKDGPKRTKDSAFSTELQQALAVIEDLIKSCELAVDLAAVTECPDDIGKLGKLLLHGPFSVWTIHKDRYKMKDLIRFKPSQRQIYLFERGIVFCKIRMEPGDQGLSPHYSFKKTMKLMTLSIRQLGRGSHRKFEIASRNGLEKYILQAASKEIRDCWFSEISKLLMEQQNNIKDQGNPQFEMSTSKGSGAGSGPWIKNMERATTSKEDPASSTGGIKGCSSREFSSMDTFEDCEGAEDMEKESSALSLAGLFQSDDSHETCSSKSAFLERGESSQGEKEERDEEET

SEQ ID NO: 49587 - protein, 570 aa, Homo sapiens
  Payload ID: 9928
  Gene Symbol: MKKS
  Gene Name: McKusick-Kaufman syndrome
  Uniprot ID: Q9NPJ1
  ENSP ID: ENSP00000246062
MSRLEAKKPSLCKSEPLTTERVRTTLSVLKRIVTSCYGPSGRLKQLHNGFGGYVCTTSQSSALLSHLLVTHPILKILTASIQNHVSSFSDCGLFTAILCCNLIENVQRLGLTPTTVIRLNKHLLSLCISYLKSETCGCRIPVDFSSTQILLCLVRSILTSKPACMLTRKETEHVSALILRAFLLTIPENAEGHIILGKSLIVPLKGQRVIDSTVLPGILIEMSEVQLMRLLPIKKSTALKVALFCTTLSGDTSDTGEGTVVVSYGVSLENAVLDQLLNLGRQLISDHVDLVLCQKVIHPSLKQFLNMHRIIAIDRIGVTLMEPLTKMTGTQPIGSLGSICPNSYGSVKDVCTAKFGSKHFFHLIPNEATICSLLLCNRNDTAWDELKLTCQTALHVLQLTLKEPWALLGGGCTETHLAAYIRHKTHNDPESILKDDECTQTELQLIAEAFCSALESVVGSLEHDGGEILTDMKYGHLWSVQADSPCVANWPDLLSQCGCGLYNSQEELNWSFLRSTRRPFVPQSCLPHEAVGSASNLTLDCLTAKLSGLQVAVETANLILDLSYVIEDKN

SEQ ID NO: 49588 - protein, 570 aa, Homo sapiens; identical to SEQ ID NO: 49587
  Payload ID: 9928
  Gene Symbol: MKKS
  Gene Name: McKusick-Kaufman syndrome
  Uniprot ID: Q9NPJ1
  ENSP ID: ENSP00000382008

SEQ ID NO: 49589 - protein, 63 aa, Homo sapiens
  Payload ID: 9928
  Gene Symbol: MKKS
  Gene Name: McKusick-Kaufman syndrome
  ENSP ID: ENSP00000477297
MSLRNLWRDYKVLVVMVPLVGLIHLGWYRIKSSPVFQIPKNDDIPEQDSLGLSNLQKSQIQGK

SEQ ID NO: 49590 - protein, 714 aa, Homo sapiens
  Payload ID: 9929
  Gene Symbol: MDM1
  Gene Name: Mdm1 nuclear protein
  Uniprot ID: Q8TC05
  ENSP ID: ENSP00000302537
MPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVTQERVHSLEASRVPKRTRSHSADSRAEGASDVENNEGVTNHTPVNENVELEHSTKVLSENVDNGLDRLLRKKAGLTVVPSYNALRNSEYQRQFVWKTSKETAPAFAANQVFHNKSQFVPPFKGNSVIHETEYKRNFKGLSPVKEPKLRNDLRENRNLETVSPERKSNKIDDRLKLEAEMELKDLHQPKRKLTPWKHQRLGKVNSEYRAKFLSPAQYLYKAGAWTHVKGNMPNQVKELREKAEFYRKRVQGTHFSRDHLNQILSDSNCCWDVSSTTSSEGTVSSNIRALDLAGDPTSHKTLQKCPSTEPEEKGNIVEEQPQKNTTEKLGVSAPTIPVRRRLAWDTENTSEDVQKQPGEKEEEDDNEEEGDRKTGKQAFMGEQEKLDVREKSKADKMKEGSDSSVSSEKGGRLPTPKLRELGGIQRTHHDLTTPAVGGAVLVSPSKMKPPAPEQRKRMTSQDCLETSKNDFTKKESRAVSLLTSPAAGIKTVDPLPLREDSEDNIHKFAEATLPVSKIPKYPTNPPGQLPSPPHVPSYWHPSRRIQGSLRDPEFQHNVGKARMNNLQLPQHEAFNDEDEDRLSEISARSAASSLRAFQTLARAKKRKENFWGKT

SEQ ID NO: 49591 - protein, 30 aa, Homo sapiens
  Payload ID: 9929
  Gene Symbol: MDM1
  Gene Name: Mdm1 nuclear protein
  ENSP ID: ENSP00000350544
  MOD_RES (1)..(1): Any amino acid
XVSGLFKLWHELRKGRRISGMRKLRFTETE

SEQ ID NO: 49592 - protein, 69 aa, Homo sapiens
  Payload ID: 9929
  Gene Symbol: MDM1
  Gene Name: Mdm1 nuclear protein
  Uniprot ID: Q8TC05
  ENSP ID: ENSP00000377175
MPVRFKGLSEYQRNFLWKKSYLSESCNSSVGRKYPWAGLRSDQLGNQGRCRTKIQHSDISSLLILVCST

SEQ ID NO: 49593 - protein, 679 aa, Homo sapiens
  Payload ID: 9929
  Gene Symbol: MDM1
  Gene Name: Mdm1 nuclear protein
  Uniprot ID: Q8TC05
  ENSP ID: ENSP00000391006
MPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVTQERVHSLEASRVPKRTRSHSADSRAEGASDVENNEGVTNHTPVNENVELEHSTKVLSENVDNGVFHNKSQFVPPFKGNSVIHETEYKRNFKGLSPVKEPKLRNDLRENRNLETVSPERKSNKIDDRLKLEAEMELKDLHQPKRKLTPWKHQRLGKVNSEYRAKFLSPAQYLYKAGAWTHVKGNMPNQGSLNAMWYAEVKELREKAEFYRKRVQGTHFSRDHLNQILSDSNCCWDVSSTTSSEGTVSSNIRALDLAGDPTSHKTLQKCPSTEPEEKGNIVEEQPQKNTTEKLGVSAPTIPVRRRLAWDTENTSEDVQKQPGEKEEEDDNEEEGDRKTGKQAFMGEQEKLDVREKSKADKMKEGSDSSVSSEKGGRLPTPKLRELGGIQRTHHDLTTPAVGGAVLVSPSKMKPPAPEQRKRMTSQDCLETSKNDFTKKESRAVSLLTSPAAGIKTVDPLPLREDSEDNIHKFAEATLPVSKIPKYPTNPPGQLPSPPHVPSYWHPSRRIQGSLRDPEFQHNVGKARMNNLQLPQHEAFNDEDEDRLSEISARSAASSLRAFQTLARAKKRKENFWGKT

SEQ ID NO: 49594 - protein, 222 aa, Homo sapiens
  Payload ID: 9929
  Gene Symbol: MDM1
  Gene Name: Mdm1 nuclear protein
  Uniprot ID: Q8TC05
  ENSP ID: ENSP00000408694
MPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVTQERVHSLEASRVPKRTRSHSADSRAEGASDVENNEGVTNHTPVNENVELEHSTKVLSENVDNGVGIFTAFLFKSIEFFIGFIVISVILHFVFQNFPLLFSCLMSIRIVDNRLLTLVIVN

SEQ ID NO: 49595 - protein, 46 aa, Homo sapiens
  Payload ID: 9929
  Gene Symbol: MDM1
  Gene Name: Mdm1 nuclear protein
  ENSP ID: ENSP00000443815
MPVRFKGLSEYQRNFLWKKSYLSESCNSSVGRKYPWAGLRSDQLVG

SEQ ID NO: 49596 - protein, 121 aa, Homo sapiens
  Payload ID: 9929
  Gene Symbol: MDM1
  Gene Name: Mdm1 nuclear protein
  ENSP ID: ENSP00000445181
KESRAVSLLTSPAAGIKTVDPLPLREDSEDNIHKFAEATLPVSKIPKYPTNPPGQLPSPPHVPSYWHPSRRIQGSLRDPEFQHNDEDRLSEISARSAASSLRAFQTLARAKKRKENFWGKT

SEQ ID NO: 49597 - protein, 280 aa, Homo sapiens
  Payload ID: 9929
  Gene Symbol: MDM1
  Gene Name: Mdm1 nuclear protein
  ENSP ID: ENSP00000446000
MGLSEYQRNFLWKKSYLSESCNSSVGRKYPWAGLRSDQLGITKEPSFISKRRVPYHDPQISKSLEWNGAISESNVVASPEPEAPETPKSQEAEQKDVTQERVHSLEASRVPKRTRSHSADSRAEGASDVENNEGVTNHTPVNENVELEHSTKVLSENVDNGLDRLLRKKAGLTVVPSYNALRNSEYQRQFVWKTSKETAPAFAANQVFHNKSQFVPPFKGNSVIHETEYKRNFKGLSPVKEPKLRNDLRENRNLETVSPERKSNKIDDRLKLEAEMELKD

SEQ ID NO: 49598 - protein, 904 aa, Homo sapiens
  Payload ID: 9930
  Gene Symbol: MTBP
  Gene Name: MDM2 binding protein
  Uniprot ID: Q96DY7
  ENSP ID: ENSP00000303398
MDRYLLLVIWGEGKFPSAASREAEHGPEVSSGEGTENQPDFTAANVYHLLKRSISASINPEDSTFPACSVGGIPGSKKWFFAVQAIYGFYQFCSSDWQEIHFDTEKDKIEDVLQTNIEECLGAVECFEEEDSNSRESLSLADLYEEAAENLHQLSDKLPAPGRAMVDIILLLSDKDPPKLKDYLPTVGALKHLREWYSAKITIAGNHCEINCQKIAEYLSANVVSLEDLRNVIDSKELWRGKIQIWERKFGFEISFPEFCLKGVTLKNFSTSNLNTDFLAKKIIPSKDKNILPKVFHYYGPALEFVQMIKLSDLPSCYMSDIEFELGLTNSTKQNSVLLLEQISSLCSKVGALFVLPCTISNILIPPPNQLSSRKWKEYIAKKPKTISVPDVEVKGECSSYYLLLQGNGNRRCKATLIHSANQINGSFALNLIHGKMKTKTEEAKLSFPFDLLSLPHFSGEQIVQREKQLANVQVLALEECLKRRKLAKQPETVSVAELKSLLVLTRKHFLDYFDAVIPKMILRKMDKIKTFNILNDFSPVEPNSSSLMETNPLEWPERHVLQNLETFEKTKQKMRTGSLPHSSEQLLGHKEGPRDSITLLDAKELLKYFTSDGLPIGDLQPLPIQKGEKTFVLTPELSPGKLQVLPFEKASVCHYHGIEYCLDDRKALERDGGFSELQSRLIRYETQTTCTRESFPVPTVLSPLPSPVVSSDPGSVPDGEVLQNELRTEVSRLKRRSKDLNCLYPRKRLVKSESSESLLSQTTGNSNHYHHHVTSRKPQTERSLPVTCPLVPIPSCETPKLATKTSSGQKSMHESKTSRQIKESRSQKHTRILKEVVTETLKKHSITETHECFTACSQRLFEISKFYLKDLKTSRGLFEEMKKTANNNAVQVIDWVLEKTSKK

SEQ ID NO: 49599 - protein, 67 aa, Homo sapiens
  Payload ID: 9930
  Gene Symbol: MTBP
  Gene Name: MDM2 binding protein
  ENSP ID: ENSP00000428574
  MOD_RES (1)..(1): Any amino acid
XILKEVVTETLKKHSITETHECFTACSQRLFEISKFYLKDLKTSRGLFEEMKKTANNNAVQGIPCSC

SEQ ID NO: 49600 - protein, 329 aa, Homo sapiens
  Payload ID: 9930
  Gene Symbol: MTBP
  Gene Name: MDM2 binding protein
  Uniprot ID: Q96DY7
  ENSP ID: ENSP00000430771
MDRYLLLVIWGEGKFPSAASREAEHGPEVSSGEGTENQPDFTAANVYHLLKRSISASINPEDSTFPACSVGGIPGSKKWFFAVQAIYGFYQFCSSDWQEIHFDTEKDKIEDVLQTNIEECLGAVECFEEEDSNSRESLSLADLYEEAAENLHQLSDKLPAPGRAMVDIILLLSDKDPPKLKDYLPTVGALKHLREWYSAKITIAGNHCEINCQKIAEYLSANVVSLEDLRNVIDSKELWRGKIQIWERKFGFEISFPEFCLKGVTLKNFSTSNLNTDFLAKKIIPSKDKNILPKVFHYYGPALEFVQMIKLSDLPSCYMSDIEFEFTED

SEQ ID NO: 49601 - protein, 442 aa, Homo sapiens
  Payload ID: 9931
  Gene Symbol: MDM2
  Gene Name: MDM2 proto-oncogene, E3 ubiquitin protein ligase
  ENSP ID: ENSP00000258148
MVRSRQMCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 49602 - protein, 497 aa, Homo sapiens
  Payload ID: 9931
  Gene Symbol: MDM2
  Gene Name: MDM2 proto-oncogene, E3 ubiquitin protein ligase
  Uniprot ID: Q00987
  ENSP ID: ENSP00000258149
MVRSRQMCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 49603 - protein, 466 aa, Homo sapiens
  Payload ID: 9931
  Gene Symbol: MDM2
  Gene Name: MDM2 proto-oncogene, E3 ubiquitin protein ligase
  ENSP ID: ENSP00000266624
MCNTNMSVPTDGAVTTSQIPASEQETLVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 49604 - protein, 321 aa, Homo sapiens
  Payload ID: 9931
  Gene Symbol: MDM2
  Gene Name: MDM2 proto-oncogene, E3 ubiquitin protein ligase
  Uniprot ID: Q00987
  ENSP ID: ENSP00000299252
MCNTNMSVPTDGAVTTSQIPASEQETLVRPKPLLLKLLKSVGAQKDTYTMKEDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 49605 - protein, 84 aa, Homo sapiens
  Payload ID: 9931
  Gene Symbol: MDM2
  Gene Name: MDM2 proto-oncogene, E3 ubiquitin protein ligase
  ENSP ID: ENSP00000310742
MVRSRQMCNTNMSVPTDGAVTTSQIPASEQETLVRPKPLLLKLLKSVGAQKDTYTMKEENIYHDLQELGSSQSAGIIGLRYICE

SEQ ID NO: 49606 - protein, 265 aa, Homo sapiens
  Payload ID: 9931
  Gene Symbol: MDM2
  Gene Name: MDM2 proto-oncogene, E3 ubiquitin protein ligase
  ENSP ID: ENSP00000335096
MSVPTDGAVTTSQIPASEQETLDLDAGVSEHSGDWLDQDSVSDQFSVEFEVESLDSEDYSLSEEGQELSDEDDEDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 49607 - protein, 321 aa, Homo sapiens; identical to SEQ ID NO: 49604
  Payload ID: 9931
  Gene Symbol: MDM2
  Gene Name: MDM2 proto-oncogene, E3 ubiquitin protein ligase
  Uniprot ID: Q00987
  ENSP ID: ENSP00000348637

SEQ ID NO: 49608 - protein, 296 aa, Homo sapiens
  Payload ID: 9931
  Gene Symbol: MDM2
  Gene Name: MDM2 proto-oncogene, E3 ubiquitin protein ligase
  Uniprot ID: Q00987
  ENSP ID: ENSP00000353611
MCNTNMSVPTDGAVTTSQIPASEQETLDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 49609 - protein, 243 aa, Homo sapiens
  Payload ID: 9931
  Gene Symbol: MDM2
  Gene Name: MDM2 proto-oncogene, E3 ubiquitin protein ligase
  ENSP ID: ENSP00000377062
MCNTNMSVPTDGAVTTSQIPASEQETLVRPKPLLLKLLKSVGAQKDTYTMKEDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 49610 - protein, 243 aa, Homo sapiens; identical to SEQ ID NO: 49609
  Payload ID: 9931
  Gene Symbol: MDM2
  Gene Name: MDM2 proto-oncogene, E3 ubiquitin protein ligase
  ENSP ID: ENSP00000377064

SEQ ID NO: 49611 - protein, 218 aa, Homo sapiens
  Payload ID: 9931
  Gene Symbol: MDM2
  Gene Name: MDM2 proto-oncogene, E3 ubiquitin protein ligase
  Uniprot ID: Q00987
  ENSP ID: ENSP00000377065
MCNTNMSVPTDGAVTTSQIPASEQETLDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 49612 - protein, 256 aa, Homo sapiens
  Payload ID: 9931
  Gene Symbol: MDM2
  Gene Name: MDM2 proto-oncogene, E3 ubiquitin protein ligase
  ENSP ID: ENSP00000377067
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVYQVTVYQAGESDTDSFEEDPEISLADYW

SEQ ID NO: 49613 - protein, 229 aa, Homo sapiens
  Payload ID: 9931
  Gene Symbol: MDM2
  Gene Name: MDM2 proto-oncogene, E3 ubiquitin protein ligase
  ENSP ID: ENSP00000377068
MCNTNMSVPTDGAVTTSQIPASEQETLVRPKPLLLKLLKSVGAQKDTYTMKERWSFTMLPRLVWNSWAQGICLPRPPKVLDLQVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLA

SEQ ID NO: 49614 - protein, 243 aa, Homo sapiens
  Payload ID: 9931
  Gene Symbol: MDM2
  Gene Name: MDM2 proto-oncogene, E3 ubiquitin protein ligase
  ENSP ID: ENSP00000410694
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEETQDKEESVESSLPLNAIEPCVICQGRPKNGCIVHGKTGHLMACFTCAKKLKKRNKPCPVCRQPIQMIVLTYFP

SEQ ID NO: 49615 - protein, 466 aa, Homo sapiens; identical to SEQ ID NO: 49603
  Payload ID: 9931
  Gene Symbol: MDM2
  Gene Name: MDM2 proto-oncogene, E3 ubiquitin protein ligase
  ENSP ID: ENSP00000417281

SEQ ID NO: 49616 - protein, 143 aa, Homo sapiens
  Payload ID: 9931
  Gene Symbol: MDM2
  Gene Name: MDM2 proto-oncogene, E3 ubiquitin protein ligase
  ENSP ID: ENSP00000427828
MCNTNMSVPTDGAVTTSQIPASEQETLVRPKPLLLKLLKSVGAQKDTYTMKEDLDAGVSEHSGDWLDQDSVSDQFSVEFEVESLDSEDYSLSEEGQELSDEDDEVYQVTVYQAGESDTDSFEEDPEISLADYWKCTSCNEMNP

SEQ ID NO: 49617 - protein, 70 aa, Homo sapiens
  Payload ID: 9931
  Gene Symbol: MDM2
  Gene Name: MDM2 proto-oncogene, E3 ubiquitin protein ligase
  ENSP ID: ENSP00000429021
MCNTNMSVPTDGAVTTSQIPASEQETLVRPKPLLLKLLKSVGAQKDTYTMKEDFLGIPGSQVKNFCTRDT

SEQ ID NO: 49618 - protein, 60 aa, Homo sapiens
  Payload ID: 9931
  Gene Symbol: MDM2
  Gene Name: MDM2 proto-oncogene, E3 ubiquitin protein ligase
  ENSP ID: ENSP00000429692
MCNTNMSVPTDGAVTTSQIPASEQETLVRPKPLLLKLLKSVGAQKDTYTMKENHRTQVHL

SEQ ID NO: 49619 - protein, 130 aa, Homo sapiens
  Payload ID: 9931
  Gene Symbol: MDM2
  Gene Name: MDM2 proto-oncogene, E3 ubiquitin protein ligase
  ENSP ID: ENSP00000430257
MCNTNMSVPTDGAVTTSQIPASEQETLVRPKPLLLKLLKSVGAQKDTYTMKEFEREETQDKEESVESSLPLNAIEPCVICQGRPKNGCIVHGKTGHLMACFTCAKKLKKRNKPCPVCRQPIQMIVLTYFP

SEQ ID NO: 49620 - protein, 49 aa, Homo sapiens
  Payload ID: 9931
  Gene Symbol: MDM2
  Gene Name: MDM2 proto-oncogene, E3 ubiquitin protein ligase
  ENSP ID: ENSP00000430906
MSVPTDGAVTTSQIPASEQETLENIYHDLQELGSSQSAGTIGNALHAMK

SEQ ID NO: 49621 - protein, 35 aa, Homo sapiens
  Payload ID: 9931
  Gene Symbol: MDM2
  Gene Name: MDM2 proto-oncogene, E3 ubiquitin protein ligase
  ENSP ID: ENSP00000431110
MCNTNMSVPTDGAVTTSQIPASEQETLNHRTQVHL

SEQ ID NO: 49622 - protein, 117 aa, Homo sapiens
  Payload ID: 9931
  Gene Symbol: MDM2
  Gene Name: MDM2 proto-oncogene, E3 ubiquitin protein ligase
  ENSP ID: ENSP00000439238
MCNTNMSVPTDGAVTTSQIPASEQETLVRPKPLLLKLLKSVGAQKDTYTMKEDLDAGVSEHSGDWLDQDSVSDQFSVEFEVESLDSEDYSLSEEGQELSDEDDEDYWKCTSCNEMNP

SEQ ID NO: 49623 - protein, 70 aa, Homo sapiens
  Payload ID: 9931
  Gene Symbol: MDM2
  Gene Name: MDM2 proto-oncogene, E3 ubiquitin protein ligase
  ENSP ID: ENSP00000441841
MCNTNMSVPTDGAVTTSQIPASEQETLVRPKPLLLKLLKSVGAQKDTYTMKEVLFYLGQYIMCKEAKEKE

SEQ ID NO: 49624 - protein, 78 aa, Homo sapiens
  Payload ID: 9931
  Gene Symbol: MDM2
  Gene Name: MDM2 proto-oncogene, E3 ubiquitin protein ligase
  ENSP ID: ENSP00000443450
MCNTNMSVPTDGAVTTSQIPASEQETLVRPKPLLLKLLKSVGAQKDTYTMKEENIYHDLQELGSSQSAGIIGLRYICE

SEQ ID NO: 49625 - protein, 78 aa, Homo sapiens; identical to SEQ ID NO: 49624
  Payload ID: 9931
  Gene Symbol: MDM2
  Gene Name: MDM2 proto-oncogene, E3 ubiquitin protein ligase
  ENSP ID: ENSP00000444028

SEQ ID NO: 49626 - protein, 257 aa, Homo sapiens
  Payload ID: 9931
  Gene Symbol: MDM2
  Gene Name: MDM2 proto-oncogene, E3 ubiquitin protein ligase
  ENSP ID: ENSP00000444430
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSE

SEQ ID NO: 49627 - protein, 84 aa, Homo sapiens
  Payload ID: 9931
  Gene Symbol: MDM2
  Gene Name: MDM2 proto-oncogene, E3 ubiquitin protein ligase
  ENSP ID: ENSP00000444566
MCNTNMSVPTDGAVTTSQIPASEQETLVRPKPLLLKLLKSVGAQKDTYTMKEKKIQMNYLVNDKENATNLIVFPFPLMKAWLCV

SEQ ID NO: 49628 - protein, 51 aa, Homo sapiens
  Payload ID: 9931
  Gene Symbol: MDM2
  Gene Name: MDM2 proto-oncogene, E3 ubiquitin protein ligase
  ENSP ID: ENSP00000444597
MCNTNMSVPTDGAVTTSQIPASEQETLVSKKVKTILSHQLLVALFIAAKKM

SEQ ID NO: 49629 - protein, 170 aa, Homo sapiens
  Payload ID: 9931
  Gene Symbol: MDM2
  Gene Name: MDM2 proto-oncogene, E3 ubiquitin protein ligase
  ENSP ID: ENSP00000445030
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETGS

SEQ ID NO: 49630 - protein, 78 aa, Homo sapiens; identical to SEQ ID NO: 49624
  Payload ID: 9931
  Gene Symbol: MDM2
  Gene Name: MDM2 proto-oncogene, E3 ubiquitin protein ligase
  ENSP ID: ENSP00000445222

SEQ ID NO: 49631 - protein, 213 aa, Homo sapiens
  Payload ID: 9932
  Gene Symbol: MDM4
  Gene Name: MDM4, p53 regulator
  ENSP ID: ENSP00000356147
MPNFVVDWRVYTDSLFLTVDFGLCAEESSTSRKRTTEDDIPTLPTSEHKCIHSREDEDLIENLAQDETSRLDLGFEEWDVAGLPWWFLGNLRSNYTPRSNGSTDLQTNQDVGTAIVSDTTDDLWFLNESVSEQLGVGIKVEAADTEQTSEEVGKVSDKKVIEVGKNDDLEDSKSLSDDTDVEVTSEDEWQCTECKKFNSPSKRYCFRCWALRK

SEQ ID NO: 49632 - protein, 131 aa, Homo sapiens
  Payload ID: 9932
  Gene Symbol: MDM4
  Gene Name: MDM4, p53 regulator
  ENSP ID: ENSP00000356148
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTEMGHLFCRISHALELAD

SEQ ID NO: 49633 - protein, 490 aa, Homo sapiens
  Payload ID: 9932
  Gene Symbol: MDM4
  Gene Name: MDM4, p53 regulator
  Uniprot ID: O15151
  ENSP ID: ENSP00000356150
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTDAAQTLALAQDHSMDIPSQDQLKQSAEESSTSRKRTTEDDIPTLPTSEHKCIHSREDEDLIENLAQDETSRLDLGFEEWDVAGLPWWFLGNLRSNYTPRSNGSTDLQTNQDVGTAIVSDTTDDLWFLNESVSEQLGVGIKVEAADTEQTSEEVGKVSDKKVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 49634 - protein, 164 aa, Homo sapiens
  Payload ID: 9932
  Gene Symbol: MDM4
  Gene Name: MDM4, p53 regulator
  Uniprot ID: O15151
  ENSP ID: ENSP00000356151
MTSFSTSAQCSTSDSACRISPGQINQENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 49635 - protein, 140 aa, Homo sapiens
  Payload ID: 9932
  Gene Symbol: MDM4
  Gene Name: MDM4, p53 regulator
  ENSP ID: ENSP00000375811
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTAKCRGKFHFQKKNYRRRYPHTAYLRA

SEQ ID NO: 49636 - protein, 171 aa, Homo sapiens
  Payload ID: 9932
  Gene Symbol: MDM4
  Gene Name: MDM4, p53 regulator
  ENSP ID: ENSP00000395254
DLIENLAQDETSRLDLGFEEWDVAGLPWWFLGNLRSNYTPRSNGSTDLQTNQVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVE

SEQ ID NO: 49637 - protein, 440 aa, Homo sapiens
  Payload ID: 9932
  Gene Symbol: MDM4
  Gene Name: MDM4, p53 regulator
  Uniprot ID: O15151
  ENSP ID: ENSP00000396840
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTDAAQTLALAQDHSMDIPSQDQLKQSAEESSTSRKRTTEDDIPTLPTSEHKCIHSREDEDLIENLAQDETSRLDLGFEEWDVAGLPWWFLGNLRSNYTPRSNGSTDLQTNQVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 49638 - protein, 140 aa, Homo sapiens; identical to SEQ ID NO: 49635
  Payload ID: 9932
  Gene Symbol: MDM4
  Gene Name: MDM4, p53 regulator
  ENSP ID: ENSP00000443816

SEQ ID NO: 49639 - protein, 267 aa, Homo sapiens
  Payload ID: 9932
  Gene Symbol: MDM4
  Gene Name: MDM4, p53 regulator
  ENSP ID: ENSP00000478080
MTSFSTSAQCSTSDSACRISPGQINQVRPKLPLLKILHAAGAQGEMFTVKEVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 49640 - protein, 116 aa, Homo sapiens
  Payload ID: 9932
  Gene Symbol: MDM4
  Gene Name: MDM4, p53 regulator
  ENSP ID: ENSP00000478581
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTGD

SEQ ID NO: 49641 - protein, 392 aa, Homo sapiens
  Payload ID: 9932
  Gene Symbol: MDM4
  Gene Name: MDM4, p53 regulator
  ENSP ID: ENSP00000482388
MTSFSTSAQCSTSDSACRISPGQINQDHSMDIPSQDQLKQSAEESSTSRKRTTEDDIPTLPTSEHKCIHSREDEDLIENLAQDETSRLDLGFEEWDVAGLPWWFLGNLRSNYTPRSNGSTDLQTNQDVGTAIVSDTTDDLWFLNESVSEQLGVGIKVEAADTEQTSEEVGKVSDKKVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 49642 - protein, 153 aa, Homo sapiens
  Payload ID: 9932
  Gene Symbol: MDM4
  Gene Name: MDM4, p53 regulator
  ENSP ID: ENSP00000482479
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTGSQYGYSKSRPTEAKCRGKFHFQKKNYRRRYPHTAYLRA

SEQ ID NO: 49643 - protein, 1116 aa, Homo sapiens
  Payload ID: 9933
  Gene Symbol: MECOM
  Gene Name: MDS1 and EVI1 complex locus
  Uniprot ID: Q03112
  ENSP ID: ENSP00000264674
MILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKQVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQFQLPDQRTWMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 49644 - protein, 1052 aa, Homo sapiens
  Payload ID: 9933
  Gene Symbol: MECOM
  Gene Name: MDS1 and EVI1 complex locus
  ENSP ID: ENSP00000394302
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKQVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQFQLPDQRTWMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 49645 - protein, 125 aa, Homo sapiens
  Payload ID: 9933
  Gene Symbol: MECOM
  Gene Name: MDS1 and EVI1 complex locus
  ENSP ID: ENSP00000417299
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSH

SEQ ID NO: 49646 - protein, 321 aa, Homo sapiens
  Payload ID: 9933
  Gene Symbol: MECOM
  Gene Name: MDS1 and EVI1 complex locus
  ENSP ID: ENSP00000417506
CDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFISFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHP

SEQ ID NO: 49647 - protein, 1230 aa, Homo sapiens
  Payload ID: 9933
  Gene Symbol: MECOM
  Gene Name: MDS1 and EVI1 complex locus
  ENSP ID: ENSP00000417899
MRSKGRARKLATNNECVYGNYPEIPLEEMPDADGVASTPSLNIQEPCSPATSSEAFTPKEGSPYKAPIYIPDDIPIPAEFELRESNMPGAGLGIWTKRKIEVGEKFGPYVGEQRSNLKDPSYGWEILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 49648 - protein, 103 aa, Homo sapiens
  Payload ID: 9933
  Gene Symbol: MECOM
  Gene Name: MDS1 and EVI1 complex locus
  ENSP ID: ENSP00000417922
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREY

SEQ ID NO: 49649 - protein, 28 aa, Homo sapiens
  Payload ID: 9933
  Gene Symbol: MECOM
  Gene Name: MDS1 and EVI1 complex locus
  ENSP ID: ENSP00000418046
MKSEDYPHETMAPDIHEERQYRCEDCDQ

SEQ ID NO: 49650 - protein, 21 aa, Homo sapiens
  Payload ID: 9933
  Gene Symbol: MECOM
  Gene Name: MDS1 and EVI1 complex locus
  ENSP ID: ENSP00000418689
MKSEDYPHETMAPDIHEERQY

SEQ ID NO: 49651 - protein, 67 aa, Homo sapiens
  Payload ID: 9933
  Gene Symbol: MECOM
  Gene Name: MDS1 and EVI1 complex locus
  ENSP ID: ENSP00000418828
MKSEDYPHETMAPDIHEERQYRCEDCDQLFESKAELADHQKFPCSTPHSAFSMVEEDFQQKLESEND

SEQ ID NO: 49652 - protein, 125 aa, Homo sapiens
  Payload ID: 9933
  Gene Symbol: MECOM
  Gene Name: MDS1 and EVI1 complex locus
  ENSP ID: ENSP00000419537
MRSKGRARKLATKGPCFPFAFHHNCKFPEASPATQNYNECVYGNYPEIPLEEMPDADGVASTPSLNIQEPCSPATSSEAFTPKEGSPYKAPIYIPDDIPIPAEFELRESNMPGAGLGIWTKRKIE

SEQ ID NO: 49653 - protein, 103 aa, Homo sapiens; identical to SEQ ID NO: 49648
  Payload ID: 9933
  Gene Symbol: MECOM
  Gene Name: MDS1 and EVI1 complex locus
  ENSP ID: ENSP00000419757

SEQ ID NO: 49654 - protein, 1042 aa, Homo sapiens
  Payload ID: 9933
  Gene Symbol: MECOM
  Gene Name: MDS1 and EVI1 complex locus
  Uniprot ID: Q03112
  ENSP ID: ENSP00000419770
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 49655 - protein, 1051 aa, Homo sapiens
  Payload ID: 9933
  Gene Symbol: MECOM
  Gene Name: MDS1 and EVI1 complex locus
  Uniprot ID: Q03112
  ENSP ID: ENSP00000419995
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQFQLPDQRTWMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 49656 - protein, 1052 aa, Homo sapiens; identical to SEQ ID NO: 49644
  Payload ID: 9933
  Gene Symbol: MECOM
  Gene Name: MDS1 and EVI1 complex locus
  ENSP ID: ENSP00000420048

SEQ ID NO: 49657 - protein, 103 aa, Homo sapiens; identical to SEQ ID NO: 49648
  Payload ID: 9933
  Gene Symbol: MECOM
  Gene Name: MDS1 and EVI1 complex locus
  ENSP ID: ENSP00000420072

SEQ ID NO: 49658 - protein, 1003 aa, Homo sapiens
  Payload ID: 9933
  Gene Symbol: MECOM
  Gene Name: MDS1 and EVI1 complex locus
  ENSP ID: ENSP00000420466
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQEESKA

SEQ ID NO: 49659 - protein, 1051 aa, Homo sapiens; identical to SEQ ID NO: 49655
  Payload ID: 9933
  Gene Symbol: MECOM
  Gene Name: MDS1 and EVI1 complex locus
  Uniprot ID: Q03112
  ENSP ID: ENSP00000486104

SEQ ID NO: 49660 - protein, 2549 aa, Homo sapiens
  Payload ID: 9934
  Gene Symbol: MTOR
  Gene Name: mechanistic target of rapamycin (serine/threonine kinase)
  Uniprot ID: P42345
  ENSP ID: ENSP00000354558
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 49661 - protein, 754 aa, Homo sapiens
  Payload ID: 9934
  Gene Symbol: MTOR
  Gene Name: mechanistic target of rapamycin (serine/threonine kinase)
  ENSP ID: ENSP00000366034
MNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 49662 - protein, 161 aa, Homo sapiens
  Payload ID: 9934
  Gene Symbol: MTOR
  Gene Name: mechanistic target of rapamycin (serine/threonine kinase)
  ENSP ID: ENSP00000398745
MLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVR

SEQ ID NO: 49663 - protein, 456 aa, Homo sapiens
  Payload ID: 9935
  Gene Symbol: MKS1
  Gene Name: Meckel syndrome, type 1
  ENSP ID: ENSP00000316631
MAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGPSWNRAPFRKGCGVCWTVWKGSASRVPFTMC

SEQ ID NO: 49664 - protein, 559 aa, Homo sapiens
  Payload ID: 9935
  Gene Symbol: MKS1
  Gene Name: Meckel syndrome, type 1
  Uniprot ID: Q9NXB0
  ENSP ID: ENSP00000376827
MAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKGERLSRFGLRTETTGTVTFRLHCLQQSRAFMESSSLQKRMRSVLDRLEGFSQQSSIHNVLEAFRRARRRMQEARESLPQDLVSPSGTLVS

SEQ ID NO: 49665 - protein, 164 aa, Homo sapiens
  Payload ID: 9935
  Gene Symbol: MKS1
  Gene Name: Meckel syndrome, type 1
  ENSP ID: ENSP00000376828
MAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEGGRHPQVTHRHLGALRRVCQEQPRH

SEQ ID NO: 49666 - protein, 549 aa, Homo sapiens
  Payload ID: 9935
  Gene Symbol: MKS1
  Gene Name: Meckel syndrome, type 1
  Uniprot ID: Q9NXB0
  ENSP ID: ENSP00000442096
MAVPVSSFAQRTRSRFRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKGERLSRFGLRTETTGTVTFRLHCLQQSRAFMESSSLQKRMRSVLDRLEGFSQQSSIHNVLEAFRRARRRMQEARESLPQDLVSPSGTLVS

SEQ ID NO: 49667 - protein, 121 aa, Homo sapiens
  Payload ID: 9935
  Gene Symbol: MKS1
  Gene Name: Meckel syndrome, type 1
  ENSP ID: ENSP00000462129
MAETVWSTDTGEAVYRSRDPVRNLRLRVHLQRITSSNFLHYQPAAELGKDLIDLATFRPQPTATLSENDHCSQRGAFILGRANGKCQASPAGQARDGGRHPQVTHRHLGALRRVCQEQPRH

SEQ ID NO: 49668 - protein, 117 aa, Homo sapiens
  Payload ID: 9935
  Gene Symbol: MKS1
  Gene Name: Meckel syndrome, type 1
  ENSP ID: ENSP00000462179
  MOD_RES (1)..(1): Any amino acid
XGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPATMTWPWH

SEQ ID NO: 49669 - protein, 48 aa, Homo sapiens
  Payload ID: 9935
  Gene Symbol: MKS1
  Gene Name: Meckel syndrome, type 1
  ENSP ID: ENSP00000462411
MAETVWSTDTGEAVYRSRDPVRNLRLRWTPPRGRRRGGDCDWVAGEAL

SEQ ID NO: 49670 - protein, 146 aa, Homo sapiens
  Payload ID: 9935
  Gene Symbol: MKS1
  Gene Name: Meckel syndrome, type 1
  ENSP ID: ENSP00000462423
MAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEVLGSMWP

SEQ ID NO: 49671 - protein, 228 aa, Homo sapiens
  Payload ID: 9935
  Gene Symbol: MKS1
  Gene Name: Meckel syndrome, type 1
  ENSP ID: ENSP00000462460
  MOD_RES (1)..(1): Any amino acid
XILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMITLSLATRRTDSKGGLAHPMTLLFIGQGGSLLLPIHV

SEQ ID NO: 49672 - protein, 211 aa, Homo sapiens
  Payload ID: 9935
  Gene Symbol: MKS1
  Gene Name: Meckel syndrome, type 1
  ENSP ID: ENSP00000463826
LWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGNRSSLPFCGPHALGPKNKTNTRMLLVRGGDNWELEMFGLKEFLFL

SEQ ID NO: 49673 - protein, 1581 aa, Homo sapiens
  Payload ID: 9936
  Gene Symbol: MED1
  Gene Name: mediator complex subunit 1
  Uniprot ID: Q15648
  ENSP ID: ENSP00000300651
MKAQGETEESEKLSKMSSLLERLHAKFNQNRPWSETIKLVRQVMEKRVVMSSGGHQHLVSCLETLQKALKVTSLPAMTDRLESIARQNGLGSHLSASGTECYITSDMFYVEVQLDPAGQLCDVKVAHHGENPVSCPELVQQLREKNFDEFSKHLKGLVNLYNLPGDNKLKTKMYLALQSLEQDLSKMAIMYWKATNAGPLDKILHGSVGYLTPRSGGHLMNLKYYVSPSDLLDDKTASPIILHENNVSRSLGMNASVTIEGTSAVYKLPIAPLIMGSHPVDNKWTPSFSSITSANSVDLPACFFLKFPQPIPVSRAFVQKLQNCTGIPLFETQPTYAPLYELITQFELSKDPDPIPLNHNMRFYAALPGQQHCYFLNKDAPLPDGRSLQGTLVSKITFQHPGRVPLILNLIRHQVAYNTLIGSCVKRTILKEDSPGLLQFEVCPLSESRFSVSFQHPVNDSLVCVVMDVQDSTHVSCKLYKGLSDALICTDDFIAKVVQRCMSIPVTMRAIRRKAETIQADTPALSLIAETVEDMVKKNLPPASSPGYGMTTGNNPMSGTTTPTNTFPGGPITTLFNMSMSIKDRHESVGHGEDFSKVSQNPILTSLLQITGNGGSTIGSSPTPPHHTPPPVSSMAGNTKNHPMLMNLLKDNPAQDFSTLYGSSPLERQNSSSGSPRMEICSGSNKTKKKKSSRLPPEKPKHQTEDDFQRELFSMDVDSQNPIFDVNMTADTLDTPHITPAPSQCSTPPTTYPQPVPHPQPSIQRMVRLSSSDSIGPDVTDILSDIAEEASKLPSTSDDCPAIGTPLRDSSSSGHSQSTLFDSDVFQTNNNENPYTDPADLIADAAGSPSSDSPTNHFFHDGVDFNPDLLNSQSQSGFGEEYFDESSQSGDNDDFKGFASQALNTLGVPMLGGDNGETKFKGNNQADTVDFSIISVAGKALAPADLMEHHSGSQGPLLTTGDLGKEKTQKRVKEGNGTSNSTLSGPGLDSKPGKRSRTPSNDGKSKDKPPKRKKADTEGKSPSHSSSNRPFTPPTSTGGSKSPGSAGRSQTPPGVATPPIPKITIQIPKGTVMVGKPSSHSQYTSSGSVSSSGSKSHHSHSSSSSSSASTSGKMKSSKSEGSSSSKLSSSMYSSQGSSGSSQSKNSSQSGGKPGSSPITKHGLSSGSSSTKMKPQGKPSSLMNPSLSKPNISPSHSRPPGGSDKLASPMKPVPGTPPSSKAKSPISSGSGGSHMSGTSSSSGMKSSSGLGSSGSLSQKTPPSSNSCTASSSSFSSSGSSMSSSQNQHGSSKGKSPSRNKKPSLTAVIDKLKHGVVTSGPGGEDPLDGQMGVSTNSSSHPMSSKHNMSGGEFQGKREKSDKDKSKVSTSGSSVDSSKKTSESKNVGSTGVAKIIISKHDGGSPSIKAKVTLQKPGESSGEGLRPQMASSKNYGSPLISGSTPKHERGSPSHSKSPAYTPQNLDSESESGSSIAEKSYQNSPSSDDGIRPLPEYSTEKHKKHKKEKKKVKDKDRDRDRDKDRDKKKSHSIKPESWSKSPISSDQSLSMTSNTILSADRPSRLSPDFMIGEEDDDLMDVALIGN

SEQ ID NO: 49674 - protein, 556 aa, Homo sapiens
  Payload ID: 9936
  Gene Symbol: MED1
  Gene Name: mediator complex subunit 1
  Uniprot ID: Q15648
  ENSP ID: ENSP00000377828
MKAQGETEESEKLSKMSSLLERLHAKFNQNRPWSETIKLVRQVMEKRVVMSSGGHQHLVSCLETLQKALKVTSLPAMTDRLESIARQNGLGSHLSASGTECYITSDMFYVEVQLDPAGQLCDVKVAHHGENPVSCPELVQQLREKNFDEFSKHLKGLVNLYNLPGDNKLKTKMYLALQSLEQDLSKMAIMYWKATNAGPLDKILHGSVGYLTPRSGGHLMNLKYYVSPSDLLDDKTASPIILHENNVSRSLGMNASVTIEGTSAVYKLPIAPLIMGSHPVDNKWTPSFSSITSANSVDLPACFFLKFPQPIPVSRAFVQKLQNCTGIPLFETQPTYAPLYELITQFELSKDPDPIPLNHNMRFYAALPGQQHCYFLNKDAPLPDGRSLQGTLVSKITFQHPGRVPLILNLIRHQVAYNTLIGSCVKRTILKEDSPGLLQFEVCPLSESRFSVSFQHPVNDSLVCVVMDVQDSTHVSCKLYKGLSDALICTDDFIAKVVQRCMSIPVTMRAIRRKAETIQADTPALSLIAETVEDMVKKNLPPASSPGSKNPELGSG

SEQ ID NO: 49675 - protein, 79 aa, Homo sapiens
  Payload ID: 9936
  Gene Symbol: MED1
  Gene Name: mediator complex subunit 1
  ENSP ID: ENSP00000462441
MKAQGETEESEKLSKMSSLLERLHAKFNQNRPWSETIKLVRQVMFCRFRNLILLVHQDFIEFSWLGVVVHICNPSTLGG

SEQ ID NO: 49676 - protein, 97 aa, Homo sapiens
  Payload ID: 9936
  Gene Symbol: MED1
  Gene Name: mediator complex subunit 1
  ENSP ID: ENSP00000463307
MKAQGETEESEKLSKMSSLLERLHAKFNQNRPWSETIKLVRQVMEKRVVMSSGGHQHLVSCLETLQKALKVTSLPAMTDRLESIARQNGAVRSLYSS

SEQ ID NO: 49677 - protein, 135 aa, Homo sapiens
  Payload ID: 9937
  Gene Symbol: MED10
  Gene Name: mediator complex subunit 10
  Uniprot ID: Q9BTT4
  ENSP ID: ENSP00000255764
MAEKFDHLEEHLEKFVENIRQLGIIVSDFQPSSQAGLNQKLNFIVTGLQDIDKCRQQLHDITVPLEVFEYIDQGRNPQLYTKECLERALAKNEQVKGKIDTMKKFKSLLIQELSKVFPEDMAKYRSIRGEDHPPS

SEQ ID NO: 49678 - protein, 117 aa, Homo sapiens
  Payload ID: 9938
  Gene Symbol: MED11
  Gene Name: mediator complex subunit 11
  Uniprot ID: Q9P086
  ENSP ID: ENSP00000293777
MATYSLANERLRALEDIEREIGAILQNAGTVILELSKEKTNERLLDRQAAAFTASVQHVEAELSAQIRYLTQVATGQPHEGSSYSSRKDCQMALKRVDYARLKLSDVARTCEQMLEN

SEQ ID NO: 49679 - protein, 93 aa, Homo sapiens
  Payload ID: 9938
  Gene Symbol: MED11
  Gene Name: mediator complex subunit 11
  ENSP ID: ENSP00000459834
MATYSLANERLRALEDIEREIGAILQNAGTVILELSKEKTNERLLDRQAAAFTASVQHVEAELSAQIRYLTQVGVSGGFCERTPALGQSLRLG

SEQ ID NO: 49680 - protein, 85 aa, Homo sapiens
  Payload ID: 9938
  Gene Symbol: MED11
  Gene Name: mediator complex subunit 11
  ENSP ID: ENSP00000460400
MATYSLANERLRALEDIEREIGAILQNAGTVILELSKEKTNERLLDRQAAAFTASVQHVEAELSAQIRYLTQLPDGLTNSNSGKK

SEQ ID NO: 49681 - protein, 2027 aa, Homo sapiens [sequence omitted]

SEQ ID NO: 49682 - protein, 2177 aa, Homo sapiens
  Payload ID: 9939
  Gene Symbol: MED12
  Gene Name: mediator complex subunit 12
  Uniprot ID: Q93074
  ENSP ID: ENSP00000363193
MAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 49683 - protein, 2176 aa, Homo sapiens
  Payload ID: 9939
  Gene Symbol: MED12
  Gene Name: mediator complex subunit 12
  Uniprot ID: Q93074
  ENSP ID: ENSP00000363215
MAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 49684 - protein, 130 aa, Homo sapiens
  Payload ID: 9939
  Gene Symbol: MED12
  Gene Name: mediator complex subunit 12
  ENSP ID: ENSP00000399084
  MOD_RES (1)..(1): Any amino acid
XTPNRRRKKQLNAAFLPQDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGY

SEQ ID NO: 49685 - protein, 251 aa, Homo sapiens
  Payload ID: 9939
  Gene Symbol: MED12
  Gene Name: mediator complex subunit 12
  ENSP ID: ENSP00000404373
  MOD_RES (1)..(1): Any amino acid
XERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPADPTRHLQQRPSGYVHQQAPTYGHGLTSTQRFSHQTLQQTPMISTMTPMSAQGVQAGVRSTAILPEQQQQQ

SEQ ID NO: 49686 - protein, 1809 aa, Homo sapiens
  Payload ID: 9940
  Gene Symbol: MED12L
  Gene Name: mediator complex subunit 12-like
  ENSP ID: ENSP00000273432
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEIFSPMPGESCENANTSLGRRMSVNCEKLVKREKPRELIFPSNYDLLRHLQYATHFPIPLDESSSHECNQRTILLYGVGKERDEARHQLKKITKDILKILNKKSTTETGVGDEGQKARKNKQETFPTLETVFTKLQLLSYFDQHQVTSQISNNVLEQITSFASGTSYHLPLAHHIQLIFDLMEPALNINGLIDFAIQLLNELSVVEAELLLKSSSLAGSYTTGLCVCIVAVLRRYHSCLILNPDQTAQVFEGLCGVVKHVVNPSECSSPERCILAYLYDLYVSCSHLRSKFGDLFSSACSKVKQTIYNNVMPANSNLRWDPDFMMDFIENPSARSINYSMLGKILSDNAANRYSFVCNTLMNVCMGHQDAGRINDIANFSSELTACCTVLSSEWLGVLKALCCSSNHVWGFNDVLCTVDVSDLSFHDSLATFIAILIARQCFSLEDVVQHVALPSLLAAACGDADAEPGARMTCRLLLHLFRAPQACFLPQATGKPFPGIRSSCDRHLLAAAHNSIEVGAVFAVLKAIMMLGDAKIGNNSVSSLKNDDFTMRGLRCDGNADDIWTASQNPKSCGKSISIETANLREYARYVLRTICQQEWVGEHCLKEPERLCTDKELILDPVLSNMQAQKLLQLICYPHGIKECTEGDNLQRQHIKRILQNLEQWTLRQSWLELQLMIKQCLKDPGSGSVAEMNNLLDNIAKATIEVFQQSADLNNSSNSGMSLFNPNSIGSADTSSTRQNGIKTFLSSSERRGVWLVAPLIARLPTSVQGRVLKAAGEELEKGQHLGSSSKKERDRQKQKSMSLLSQQPFLSLVLTCLKGQDEQREGLLTSLQNQVNQILSNWREERYQDDIKARQMMHEALQLRLNLVGGMFDTVQRSTQWTTDWALLLLQIITSGTVDMHTNNELFTTVLDMLGVLINGTLASDLSNASPGGSEENKRAYMNLVKKLKKELGDKRSESIDKVRQLLPLPKQTCDVITCEPMGSLIDTKGNKIAGFDSIDKKQGLQVSTKQKVSPWDLFEGQKNPAPLSWAWFGTVRVDRRVIKYEEQHHLLLYHTHPMPKPRSYYLQPLPLPPEEEEEEPTSPVSQEPERKSAELSDQGKTTTDEEKKTKGRKRKTKSSSRVDEYPQSNIYRVPPNYSPISSQMMHHPQSTLWGYNLVGQPQQPGFFLQNQSLTPGGSRLDPAGSFVPTNTKQALSNMLQRRSGAMMQPPSLHAITSQQQLIQMKLLQQQQQQRLLRQAQTRPFQQFPRQGLQQTQQQQQTAALVRQLQKQLSSNQPQQGVTPYGHPSHF

SEQ ID NO: 49687 - protein, 756 aa, Homo sapiens
  Payload ID: 9940
  Gene Symbol: MED12L
  Gene Name: mediator complex subunit 12-like
  Uniprot ID: Q86YW9
  ENSP ID: ENSP00000310760
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQYSDEFVQSAYLSRRLAYFCARRLSLLLSDSPNLLAAHSPHMMIGPNNSSIGAPSPGPPGPGMSPVQLAFSDFLSCAQHGPLVYGLSCMLQTVTLCCPSALVWNYSTNENKSANPGSPLDLLQVAPSSLPMPGGNTAFNQQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEEQSIMAHMGIDSGTTNIFDEVDKSDFKTDFGSEFPIFSPMPGESCENANTSLGRRMSVNCEKLVKREKPRELIFPSNYDLLRHLQYATHFPIPLVSHCFS

SEQ ID NO: 49688 - protein, 721 aa, Homo sapiens
  Payload ID: 9940
  Gene Symbol: MED12L
  Gene Name: mediator complex subunit 12-like
  Uniprot ID: Q86YW9
  ENSP ID: ENSP00000403308
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQYSDEFVQSAYLSRRLAYFCARRLSLLLSDSPNLLAAHSPHMMIGPNNSSIGAPSPGPPGPGMSPVQLAFSDFLSCAQHGPLVYGLSCMLQTVTLCCPSALVWNYSTNENKSANPGSPLDLLQVAPSSLPMPGGNTAFNQQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEIFSPMPGESCENANTSLGRRMSVNCEKLVKREKPRELIFPSNYDLLRHLQYATHFPIPLVSHCFS

SEQ ID NO: 49689 - protein, 2145 aa, Homo sapiens
  Payload ID: 9940
  Gene Symbol: MED12L
  Gene Name: mediator complex subunit 12-like
  Uniprot ID: Q86YW9
  ENSP ID: ENSP00000417235
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQYSDEFVQSAYLSRRLAYFCARRLSLLLSDSPNLLAAHSPHMMIGPNNSSIGAPSPGPPGPGMSPVQLAFSDFLSCAQHGPLVYGLSCMLQTVTLCCPSALVWNYSTNENKSANPGSPLDLLQVAPSSLPMPGGNTAFNQQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEIFSPMPGESCENANTSLGRRMSVNCEKLVKREKPRELIFPSNYDLLRHLQYATHFPIPLDESSSHECNQRTILLYGVGKERDEARHQLKKITKDILKILNKKSTTETGVGDEGQKARKNKQETFPTLETVFTKLQLLSYFDQHQVTSQISNNVLEQITSFASGTSYHLPLAHHIQLIFDLMEPALNINGLIDFAIQLLNELSVVEAELLLKSSSLAGSYTTGLCVCIVAVLRRYHSCLILNPDQTAQVFEGLCGVVKHVVNPSECSSPERCILAYLYDLYVSCSHLRSKFGDLFSSACSKVKQTIYNNVMPANSNLRWDPDFMMDFIENPSARSINYSMLGKILSDNAANRYSFVCNTLMNVCMGHQDAGRINDIANFSSELTACCTVLSSEWLGVLKALCCSSNHVWGFNDVLCTVDVSDLSFHDSLATFIAILIARQCFSLEDVVQHVALPSLLAAACGDADAEPGARMTCRLLLHLFRAPQACFLPQATGKPFPGIRSSCDRHLLAAAHNSIEVGAVFAVLKAIMMLGDAKIGNNSVSSLKNDDFTMRGLRCDGNADDIWTASQNPKSCGKSISIETANLREYARYVLRTICQQEWVGEHCLKEPERLCTDKELILDPVLSNMQAQKLLQLICYPHGIKECTEGDNLQRQHIKRILQNLEQWTLRQSWLELQLMIKQCLKDPGSGSVAEMNNLLDNIAKATIEVFQQSADLNNSSNSGMSLFNPNSIGSADTSSTRQNGIKTFLSSSERRGVWLVAPLIARLPTSVQGRVLKAAGEELEKGQHLGSSSKKERDRQKQKSMSLLSQQPFLSLVLTCLKGQDEQREGLLTSLQNQVNQILSNWREERYQDDIKARQMMHEALQLRLNLVGGMFDTVQRSTQWTTDWALLLLQIITSGTVDMHTNNELFTTVLDMLGVLINGTLASDLSNASPGGSEENKRAYMNLVKKLKKELGDKRSESIDKVRQLLPLPKQTCDVITCEPMGSLIDTKGNKIAGFDSIDKKQGLQVSTKQKVSPWDLFEGQKNPAPLSWAWFGTVRVDRRVIKYEEQHHLLLYHTHPMPKPRSYYLQPLPLPPEEEEEEPTSPVSQEPERKSAELSDQGKTTTDEEKKTKGRKRKTKSSSRVDEYPQSNIYRVPPNYSPISSQMMHHPQSTLWGYNLVGQPQQPGFFLQNQSLTPGGSRLDPAGSFVPTNTKQALSNMLQRRSGAMMQPPSLHAITSQQQLIQMKLLQQQQQQRLLRQAQTRPFQQGQPGDQAALFAAQARPSPQLPQYPGLQQAQTMPQGYTMYGTQMPLQQTSQQQAGSVVLSPSYNSRAYPAAHSNPVLMERLRQIQQQPSGYVQQQASPYLQPLTGSQRLNHQALQQSPLVGGGIDAVLTSAHPNLPSVPLPQDPMRPRQPQVRQQQRLLQMQQPQQPQPQQPPQPQQSSQSQSQTLGLQAMQPQQPLFPRQGLQQTQQQQQTAALVRQLQKQLSSNQPQQGVTPYGHPSHF

SEQ ID NO: 49690 - protein, 74 aa, Homo sapiens
  Payload ID: 9940
  Gene Symbol: MED12L
  Gene Name: mediator complex subunit 12-like
  ENSP ID: ENSP00000417420
  MOD_RES (1)..(1): Any amino acid
XDVKMEIFSPMPGESCENANTSLGRRMSVNCEKLVKREKPRELIFPSNYDLLRHLQYATHFPIPLVLMSVPPSV

SEQ ID NO: 49691 - protein, 2174 aa, Homo sapiens
  Payload ID: 9941
  Gene Symbol: MED13
  Gene Name: mediator complex subunit 13
  Uniprot ID: Q9UHV7
  ENSP ID: ENSP00000380888
MSASFVPNGASLEDCHCNLFCLADLTGIKWKKYVWQGPTSAPILFPVTEEDPILSSFSRCLKADVLGVWRRDQRPGRRELWIFWWGEDPSFADLIHHDLSEEEDGVWENGLSYECRTLLFKAVHNLLERCLMNRNFVRIGKWFVKPYEKDEKPINKSEHLSCSFTFFLHGDSNVCTSVEINQHQPVYLLSEEHITLAQQSNSPFQVILCPFGLNGTLTGQAFKMSDSATKKLIGEWKQFYPISCCLKEMSEEKQEDMDWEDDSLAAVEVLVAGVRMIYPACFVLVPQSDIPTPSPVGSTHCSSSCLGVHQVPASTRDPAMSSVTLTPPTSPEEVQTVDPQSVQKWVKFSSVSDGFNSDSTSHHGGKIPRKLANHVVDRVWQECNMNRAQNKRKYSASSGGLCEEATAAKVASWDFVEATQRTNCSCLRHKNLKSRNAGQQGQAPSLGQQQQILPKHKTNEKQEKSEKPQKRPLTPFHHRVSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDAPRPTSHARPPSTSLIYDSDLAVSYTDLDNLFNSDEDELTPGSKKSANGSDDKASCKESKTGNLDPLSCISTADLHKMYPTPPSLEQHIMGFSPMNMNNKEYGSMDTTPGGTVLEGNSSSIGAQFKIEVDEGFCSPKPSEIKDFSYVYKPENCQILVGCSMFAPLKTLPSQYLPPIKLPEECIYRQSWTVGKLELLSSGPSMPFIKEGDGSNMDQEYGTAYTPQTHTSFGMPPSSAPPSNSGAGILPSPSTPRFPTPRTPRTPRTPRGAGGPASAQGSVKYENSDLYSPASTPSTCRPLNSVEPATVPSIPEAHSLYVNLILSESVMNLFKDCNFDSCCICVCNMNIKGADVGVYIPDPTQEAQYRCTCGFSAVMNRKFGNNSGLFLEDELDIIGRNTDCGKEAEKRFEALRATSAEHVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRARRKKSSARKFGLQKLWEWCLGLVQMSSLPWRVVIGRLGRIGHGELKDWSCLLSRRNLQSLSKRLKDMCRMCGISAADSPSILSACLVAMEPQGSFVIMPDSVSTGSVFGRSTTLNMQTSQLNTPQDTSCTHILVFPTSASVQVASATYTTENLDLAFNPNNDGADGMGIFDLLDTGDDLDPDIINILPASPTGSPVHSPGSHYPHGGDAGKGQSTDRLLSTEPHEEVPNILQQPLALGYFVSTAKAGPLPDWFWSACPQAQYQCPLFLKASLHLHVPSVQSDELLHSKHSHPLDSNQTSDVLRFVLEQYNALSWLTCDPATQDRRSCLPIHFVVLNQLYNFIMNML

SEQ ID NO: 49692 - protein, 327 aa, Homo sapiens
  Payload ID: 9941
  Gene Symbol: MED13
  Gene Name: mediator complex subunit 13
  ENSP ID: ENSP00000464131
  MOD_RES (1)..(1): Any amino acid
XVQKWVKFSSVSDGFNSDSTSHHGGKIPRKLANHVVDRVWQECNMNRAQNKRKYSASSGGLCEEATAAKVASWDFVEATQRTNCSCLRHKNLKSRNAGQQGQAPSLGQQQQILPKHKTNEKQEKSEKPQKRPLTPFHHRVSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTEYVFFLIVTIII

SEQ ID NO: 49693 - protein, 2210 aa, Homo sapiens
  Payload ID: 9942
  Gene Symbol: MED13L
  Gene Name: mediator complex subunit 13-like
  Uniprot ID: Q71F56
  ENSP ID: ENSP00000281928
MTAAANWVANGASLEDCHSNLFSLAELTGIKWRRYNFGGHGDCGPIISAPAQDDPILLSFIRCLQANLLCVWRRDVKPDCKELWIFWWGDEPNLVGVIHHELQVVEEGLWENGLSYECRTLLFKAIHNLLERCLMDKNFVRIGKWFVRPYEKDEKPVNKSEHLSCAFTFFLHGESNVCTSVEIAQHQPIYLINEEHIHMAQSSPAPFQVLVSPYGLNGTLTGQAYKMSDPATRKLIEEWQYFYPMVLKKKEESKEEDELGYDDDFPVAVEVIVGGVRMVYPSAFVLISQNDIPVPQSVASAGGHIAVGQQGLGSVKDPSNCGMPLTPPTSPEQAILGESGGMQSAASHLVSQDGGMITMHSPKRSGKIPPKLHNHMVHRVWKECILNRTQSKRSQMSTPTLEEEPASNPATWDFVDPTQRVSCSCSRHKLLKRCAVGPNRPPTVSQPGFSAGPSSSSSLPPPASSKHKTAERQEKGDKLQKRPLIPFHHRPSVAEELCMEQDTPGQKLGLAGIDSSLEVSSSRKYDKQMAVPSRNTSKQMNLNPMDSPHSPISPLPPTLSPQPRGQETESLDPPSVPVNPALYGNGLELQQLSTLDDRTVLVGQRLPLMAEVSETALYCGIRPSNPESSEKWWHSYRLPPSDDAEFRPPELQGERCDAKMEVNSESTALQRLLAQPNKRFKIWQDKQPQLQPLHFLDPLPLSQQPGDSLGEVNDPYTFEDGDIKYIFTANKKCKQGTEKDSLKKNKSEDGFGTKDVTTPGHSTPVPDGKNAMSIFSSATKTDVRQDNAAGRAGSSSLTQVTDLAPSLHDLDNIFDNSDDDELGAVSPALRSSKMPAVGTEDRPLGKDGRAAVPYPPTVADLQRMFPTPPSLEQHPAFSPVMNYKDGISSETVTALGMMESPMVSMVSTQLTEFKMEVEDGLGSPKPEEIKDFSYVHKVPSFQPFVGSSMFAPLKMLPSHCLLPLKIPDACLFRPSWAIPPKIEQLPMPPAATFIRDGYNNVPSVGSLADPDYLNTPQMNTPVTLNSAAPASNSGAGVLPSPATPRFSVPTPRTPRTPRTPRGGGTASGQGSVKYDSTDQGSPASTPSTTRPLNSVEPATMQPIPEAHSLYVTLILSDSVMNIFKDRNFDSCCICACNMNIKGADVGLYIPDSSNEDQYRCTCGFSAIMNRKLGYNSGLFLEDELDIFGKNSDIGQAAERRLMMCQSTFLPQVEGTKKPQEPPISLLLLLQNQHTQPFASLNFLDYISSNNRQTLPCVSWSYDRVQADNNDYWTECFNALEQGRQYVDNPTGGKVDEALVRSATVHSWPHSNVLDISMLSSQDVVRMLLSLQPFLQDAIQKKRTGRTWENIQHVQGPLTWQQFHKMAGRGTYGSEESPEPLPIPTLLVGYDKDFLTISPFSLPFWERLLLDPYGGHRDVAYIVVCPENEALLEGAKTFFRDLSAVYEMCRLGQHKPICKVLRDGIMRVGKTVAQKLTDELVSEWFNQPWSGEENDNHSRLKLYAQVCRHHLAPYLATLQLDSSLLIPPKYQTPPAAAQGQATPGNAGPLAPNGSAAPPAGSAFNPTSNSSSTNPAASSSASGSSVPPVSSSASAPGISQISTTSSSGFSGSVGGQNPSTGGISADRTQGNIGCGGDTDPGQSSSQPSQDGQESVTERERIGIPTEPDSADSHAHPPAVVIYMVDPFTYAAEEDSTSGNFWLLSLMRCYTEMLDNLPEHMRNSFILQIVPCQYMLQTMKDEQVFYIQYLKSMAFSVYCQCRRPLPTQIHIKSLTGFGPAASIEMTLKNPERPSPIQLYSPPFILAPIKDKQTELGETFGEASQKYNVLFVGYCLSHDQRWLLASCTDLHGELLETCVVNIALPNRSRRSKVSARKIGLQKLWEWCIGIVQMTSLPWRVVIGRLGRLGHGELKDWSILLGECSLQTISKKLKDVCRMCGISAADSPSILSACLVAMEPQGSFVVMPDAVTMGSVFGRSTALNMQSSQLNTPQDASCTHILVFPTSSTIQVAPANYPNEDGFSPNNDDMFVDLPFPDDMDNDIGILMTGNLHSSPNSSPVPSPGSPSGIGVGSHFQHSRSQGERLLSREAPEELKQQPLALGYFVSTAKAENLPQWFWSSCPQAQNQCPLFLKASLHHHISVAQTDELLPARNSQRVPHPLDSKTTSDVLRFVLEQYNALSWLTCNPATQDRTSCLPVHFVVLTQLYNAIMNIL

SEQ ID NO: 49694 - protein, 190 aa, Homo sapiens
  Payload ID: 9942
  Gene Symbol: MED13L
  Gene Name: mediator complex subunit 13-like
  ENSP ID: ENSP00000446782
  MOD_RES (1)..(1): Any amino acid
XPLAPNGSAAPPAGSAFNPTSNSSSTNPAASSSASGSSVPPVSSSASAPGISQISTTSSSGFSGSVGGQNPSTGGISADRTQGNIGCGGDTDPGQSSSQPSQDGQESVTERERIGIPTEPDSADSHAHPPAVVIYMVDPFTYAAEEDSTSGNFWLLSLMRCYTEMLDNLPEHMRNSFILQVTVCKFIIYF

SEQ ID NO: 49695 - protein, 93 aa, Homo sapiens
  Payload ID: 9942
  Gene Symbol: MED13L
  Gene Name: mediator complex subunit 13-like
  ENSP ID: ENSP00000448553
MLESRKAIAPSRRKAELTGIKWRRYNFGGHGDCGPIISAPAQDDPILLSFIRCLQANLLCVWRRDVKPDCKELWIFWWGDEPNLVGVIHHELQ

SEQ ID NO: 49696 - protein, 140 aa, Homo sapiens
  Payload ID: 9942
  Gene Symbol: MED13L
  Gene Name: mediator complex subunit 13-like
  ENSP ID: ENSP00000449876
ERIGIPTEPDSADSHAHPPAVVIYMVDPFTYAAEEDSTSGNFWLLSLMRCYTEMLDNLPEHMRNSFILQIVPCQYMLQTMKDEQVFYIQYLKSMAFSVYCQCRRPLPTQIHIKSLTGFGPAASIEMTLKNPEVGIGRTET

SEQ ID NO: 49697 - protein, 195 aa, Homo sapiens
  Payload ID: 9942
  Gene Symbol: MED13L
  Gene Name: mediator complex subunit 13-like
  ENSP ID: ENSP00000449895
  MOD_RES (1)..(1): Any amino acid
XQTELGETFGEASQKYNVLFVGYCLSHDQRWLLASCTDLHGELLETCVVNIALPNRDPFPFPISLFVRSRRSKVSARKIGLQKLWEWCIGIVQMTSLPWRVVIGRLGRLGHGELKDWSILLGECSLQTISKKLKDVCRMCGISAADSPSILSACLVAMEPQGSFVVMPDAVTMGSVFGRSTALNMQSSQLNTPQD

SEQ ID NO: 49698 - protein, 1454 aa, Homo sapiens
  Payload ID: 9943
  Gene Symbol: MED14
  Gene Name: mediator complex subunit 14
  Uniprot ID: O60244
  ENSP ID: ENSP00000323720
MAPVQLENHQLVPPGGGGGGSGGPPSAPAPPPPGAAVAAAAAAAASPGYRLSTLIEFLLHRAYSELMVLTDLLPRKSDVERKIEIVQFASRTRQLFVRLLALVKWANNAGKVEKCAMISSFLDQQAILFVDTADRLASLARDALVHARLPSFAIPYAIDVLTTGSYPRLPTCIRDKIIPPDPITKIEKQATLHQLNQILRHRLVTTDLPPQLANLTVANGRVKFRVEGEFEATLTVMGDDPDVPWRLLKLEILVEDKETGDGRALVHSMQISFIHQLVQSRLFADEKPLQDMYNCLHSFCLSLQLEVLHSQTLMLIRERWGDLVQVERYHAGKCLSLSVWNQQVLGRKTGTASVHKVTIKIDENDVSKPLQIFHDPPLPASDSKLVERAMKIDHLSIEKLLIDSVHARAHQKLQELKAILRGFNANENSSIETALPALVVPILEPCGNSECLHIFVDLHSGMFQLMLYGLDQATLDDMEKSVNDDMKRIIPWIQQLKFWLGQQRCKQSIKHLPTISSETLQLSNYSTHPIGNLSKNKLFIKLTRLPQYYIVVEMLEVPNKPTQLSYKYYFMSVNAADREDSPAMALLLQQFKENIQDLVFRTKTGKQTRTNAKRKLSDDPCPVESKKTKRAGEMCAFNKVLAHFVAMCDTNMPFVGLRLELSNLEIPHQGVQVEGDGFSHAIRLLKIPPCKGITEETQKALDRSLLDCTFRLQGRNNRTWVAELVFANCPLNGTSTREQGPSRHVYLTYENLLSEPVGGRKVVEMFLNDWNSIARLYECVLEFARSLPDIPAHLNIFSEVRVYNYRKLILCYGTTKGSSISIQWNSIHQKFHISLGTVGPNSGCSNCHNTILHQLQEMFNKTPNVVQLLQVLFDTQAPLNAINKLPTVPMLGLTQRTNTAYQCFSILPQSSTHIRLAFRNMYCIDIYCRSRGVVAIRDGAYSLFDNSKLVEGFYPAPGLKTFLNMFVDSNQDARRRSVNEDDNPPSPIGGDMMDSLISQLQPPPQQQPFPKQPGTSGAYPLTSPPTSYHSTVNQSPSMMHTQSPGNLHAASSPSGALRAPSPASFVPTPPPSSHGISIGPGASFASPHGTLDPSSPYTMVSPSGRAGNWPGSPQVSGPSPAARMPGMSPANPSLHSPVPDASHSPRAGTSSQTMPTNMPPPRKLPQRSWAASIPTILTHSALNILLLPSPTPGLVPGLAGSYLCSPLERFLGSVIMRRHLQRIIQQETLQLINSNEPGVIMFKTDALKCRVALSPKTNQTLQLKVTPENAGQWKPDELQVLEKFFETRVAGPPFKANTLIAFTKLLGAPTHILRDCVHIMKLELFPDQATQLKWNVQFCLTIPPSAPPIAPPGTPAVVLKSKMLFFLQLTQKTSVPPQEPVSIIVPIIYDMASGTTQQADIPRQQNSSVAAPMMVSNILKRFAEMNPPRQGECTIFAAVRDLMANLTLPPGGRP

SEQ ID NO: 49699 - protein, 155 aa, Homo sapiens
  Payload ID: 9943
  Gene Symbol: MED14
  Gene Name: mediator complex subunit 14
  ENSP ID: ENSP00000392586
VAGPPFKANTLIAFTKLLGAPTHILRDCVHIMKLELFPDQATQLKWNVQFCLTIPPSAPPIAPPGTPAVVLKSKMLFFLQLTQKTSVPPQEPVSIIVPIIYDMASGTTQQADIPRQQNSSVAAPMMVSNILKRFAEMNPPRQGSIKGTGCPSDFL

SEQ ID NO: 49700 - protein, 331 aa, Homo sapiens
  Payload ID: 9943
  Gene Symbol: MED14
  Gene Name: mediator complex subunit 14
  ENSP ID: ENSP00000411357
PSGRAGNWPGSPQVSGPSPAARMPGMSPANPSLHSPVPDASHSPRAGTSSQTMPTNMPPPRKLPQRSWAASIPTILTHSALNILLLPSPTPGLVPGLAGSYLCSPLERFLGSVIMRRHLQRIIQQETLQLINSNEPGVIMFKTDALKCRVALSPKTNQTLQLKVTPENAGQWKPDELQVLEKFFETRVAGPPFKANTLIAFTKLLGAPTHILRDCVHIMKLELFPDQATQLKWNVQFCLTIPPSAPPIAPPGTPAVVLKSKMLFFLQLTQKTSVPPQEPVSIIVPIIYDMASGTTQQADIPRQQNSSVAAPMMVSNILKRFAEMNPPRQGT

SEQ ID NO: 49701 - protein, 788 aa, Homo sapiens
  Payload ID: 9944
  Gene Symbol: MED15
  Gene Name: mediator complex subunit 15
  Uniprot ID: Q96RN5
  ENSP ID: ENSP00000263205
MDVSGQETDWRSTAFRQKLVSQIEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQMITEALAQGGMHIRARFPPTTAVSAIPSSSIPLGRQPMAQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 49702 - protein, 748 aa, Homo sapiens
  Payload ID: 9944
  Gene Symbol: MED15
  Gene Name: mediator complex subunit 15
  Uniprot ID: Q96RN5
  ENSP ID: ENSP00000292733
MDVSGQETDWRSTAFRQKLVSQIEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 49703 - protein, 677 aa, Homo sapiens
  Payload ID: 9944
  Gene Symbol: MED15
  Gene Name: mediator complex subunit 15
  Uniprot ID: Q96RN5
  ENSP ID: ENSP00000372434
MDVSGQETDWRSTAFRQKLVSQIEDAMRKAGVAHSKSSKDMESHVFLKAKTRDEYLSLVARLIIHFRDIHNKKSQASVSAQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 49704 - protein, 722 aa, Homo sapiens
  Payload ID: 9944
  Gene Symbol: MED15
  Gene Name: mediator complex subunit 15
  ENSP ID: ENSP00000384344
MRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 49705 - protein, 124 aa, Homo sapiens
  Payload ID: 9944
  Gene Symbol: MED15
  Gene Name: mediator complex subunit 15
  ENSP ID: ENSP00000390498
MRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQ

SEQ ID NO: 49706 - protein, 55 aa, Homo sapiens
  Payload ID: 9944
  Gene Symbol: MED15
  Gene Name: mediator complex subunit 15
  ENSP ID: ENSP00000391108
MDVSGQETDWRSTAFRQKLVSQIEDAMRKAGVAHSKSSKDMESHVFLKAKTRVRP

SEQ ID NO: 49707 - protein, 141 aa, Homo sapiens
  Payload ID: 9944
  Gene Symbol: MED15
  Gene Name: mediator complex subunit 15
  ENSP ID: ENSP00000392738
MRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQ

SEQ ID NO: 49708 - protein, 165 aa, Homo sapiens
  Payload ID: 9944
  Gene Symbol: MED15
  Gene Name: mediator complex subunit 15
  ENSP ID: ENSP00000396461
MGFSSDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQ

SEQ ID NO: 49709 - protein, 120 aa, Homo sapiens
  Payload ID: 9944
  Gene Symbol: MED15
  Gene Name: mediator complex subunit 15
  ENSP ID: ENSP00000407742
MRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVST

SEQ ID NO: 49710 - protein, 105 aa, Homo sapiens
  Payload ID: 9944
  Gene Symbol: MED15
  Gene Name: mediator complex subunit 15
  ENSP ID: ENSP00000408742
MRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPP

SEQ ID NO: 49711 - protein, 105 aa, Homo sapiens
  Payload ID: 9944
  Gene Symbol: MED15
  Gene Name: mediator complex subunit 15
  ENSP ID: ENSP00000408794
MRKAGVAHSKSSKDMESHVFLKAKTRDEYLSLVARLIIHFRDIHNKKSQASVSAQLQLQQVALQQQQQQQQFQQQQQAALQQQQQQQQQQQFQAQQSAMQQQFQA

SEQ ID NO: 49712 - protein, 194 aa, Homo sapiens
  Payload ID: 9944
  Gene Symbol: MED15
  Gene Name: mediator complex subunit 15
  ENSP ID: ENSP00000408875
  MOD_RES (1)..(1): Any amino acid
XFQRRPSKRLNLPCRMGFSSDEYLSLVARLIIHFRDIHNKKSQASVSDPMNALQSLTGGPAAGAAGIGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQ

SEQ ID NO: 49713 - protein, 54 aa, Homo sapiens
  Payload ID: 9944
  Gene Symbol: MED15
  Gene Name: mediator complex subunit 15
  ENSP ID: ENSP00000409578
MDVSGQETDWRSTAFRQKLVSQIEDAMRKAGVAHSKSSKDMESHVFLKAKTRIL

SEQ ID NO: 49714 - protein, 119 aa, Homo sapiens
  Payload ID: 9944
  Gene Symbol: MED15
  Gene Name: mediator complex subunit 15
  ENSP ID: ENSP00000410173
MAGSRCQEAIVVSGGEREELGSVAPLRGTLAPHHRLLVSVSSFFHARPCEETTKQALWSHSVTQAEVQWRDCGSLQPPPPGLKRSSHVSLPSSWDHSEDAMRKAGVAHSKSSKDMESHV

SEQ ID NO: 49715 - protein, 82 aa, Homo sapiens
  Payload ID: 9944
  Gene Symbol: MED15
  Gene Name: mediator complex subunit 15
  ENSP ID: ENSP00000413603
MGFSSDEYLSLVARLIIHFRDIHNKKSQASVSAQLQLQQVALQQQQQQQQFQQQQQAALQQQQQQQQQQQFQAQQSAMQQQF

SEQ ID NO: 49716 - protein, 61 aa, Homo sapiens
  Payload ID: 9944
  Gene Symbol: MED15
  Gene Name: mediator complex subunit 15
  ENSP ID: ENSP00000413636
MAGSRCQEAIVVSGGEREELGSVAPLRGTLAPHHRLLVSVSSFFHARPCEETTKQALSRMP

SEQ ID NO: 49717 - protein, 160 aa, Homo sapiens
  Payload ID: 9944
  Gene Symbol: MED15
  Gene Name: mediator complex subunit 15
  ENSP ID: ENSP00000415778
MKRGHSRWLPALSDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQ

SEQ ID NO: 49718 - protein, 36 aa, Homo sapiens
  Payload ID: 9944
  Gene Symbol: MED15
  Gene Name: mediator complex subunit 15
  ENSP ID: ENSP00000416109
MGFSSDEYLSLVARLIIHFRDIRTVAWLVHTVLWGS

SEQ ID NO: 49719 - protein, 218 aa, Homo sapiens
  Payload ID: 9945
  Gene Symbol: MED16
  Gene Name: mediator complex subunit 16
  ENSP ID: ENSP00000269814
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSPTEECKACTRCGCVTMLKSPNRTTAVKQWEQRWIKNCLCGGLWWRVPLSYP

SEQ ID NO: 49720 - protein, 860 aa, Homo sapiens
  Payload ID: 9945
  Gene Symbol: MED16
  Gene Name: mediator complex subunit 16
  Uniprot ID: Q9Y2X0
  ENSP ID: ENSP00000308528
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICFPSTGPCSVWVLLGWQPLPGRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYP

SEQ ID NO: 49721 - protein, 877 aa, Homo sapiens
  Payload ID: 9945
  Gene Symbol: MED16
  Gene Name: mediator complex subunit 16
  Uniprot ID: Q9Y2X0
  ENSP ID: ENSP00000325612
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLAVEGRGPDACVTSRASEEAPAFVQLGPQSTHHSPRTPRSLDHLHPEDRP

SEQ ID NO: 49722 - protein, 841 aa, Homo sapiens
  Payload ID: 9945
  Gene Symbol: MED16
  Gene Name: mediator complex subunit 16
  Uniprot ID: Q9Y2X0
  ENSP ID: ENSP00000379153
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYP

SEQ ID NO: 49723 - protein, 877 aa, Homo sapiens; identical to SEQ ID NO: 49721
  Payload ID: 9945
  Gene Symbol: MED16
  Gene Name: mediator complex subunit 16
  Uniprot ID: Q9Y2X0
  ENSP ID: ENSP00000464810

SEQ ID NO: 49724 - protein, 462 aa, Homo sapiens
  Payload ID: 9945
  Gene Symbol: MED16
  Gene Name: mediator complex subunit 16
  ENSP ID: ENSP00000465762
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVL

SEQ ID NO: 49725 - protein, 74 aa, Homo sapiens
  Payload ID: 9945
  Gene Symbol: MED16
  Gene Name: mediator complex subunit 16
  ENSP ID: ENSP00000465823
MCDLRRPAAGGMMDLAYVCEWEKWSKSTHCPSVPLACAWSCRNLIAFTMDLRSDDQGLLCSCGGTACSLSCRLG

SEQ ID NO: 49726 - protein, 49 aa, Homo sapiens
  Payload ID: 9945
  Gene Symbol: MED16
  Gene Name: mediator complex subunit 16
  ENSP ID: ENSP00000465827
MCDLRRPAAGGMMDLAYVCEWEKWSKSTHCPSVPLACAWSCRNLIAFTM

SEQ ID NO: 49727 - protein, 537 aa, Homo sapiens
  Payload ID: 9945
  Gene Symbol: MED16
  Gene Name: mediator complex subunit 16
  ENSP ID: ENSP00000466868
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKVLSTRILAMKASLCKLSPCTVTRVCDYHTKLFLIAISSTLKSLLRPHFLNTPDKSPGDRLTEICTKITDVDIDKVMINLKTEEFVL

SEQ ID NO: 49728 - protein, 663 aa, Homo sapiens
  Payload ID: 9945
  Gene Symbol: MED16
  Gene Name: mediator complex subunit 16
  ENSP ID: ENSP00000475528
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQPSPTSEPSPTSEPCPTSEPSPTSEPSSP

SEQ ID NO: 49729 - protein, 505 aa, Homo sapiens
  Payload ID: 9945
  Gene Symbol: MED16
  Gene Name: mediator complex subunit 16
  ENSP ID: ENSP00000475725
  MOD_RES (1)..(1): Any amino acid
XVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQVAMRAQRASRTRRWWMNAACCPASCLSPAWTGCQPATAWLAACSPSSPFVCSLAGRPRCLAVLPPCSSTASPGPQASPRSTTCGGCTLALAPRRNARPAPGAAVSPCSSRPTEPRR

SEQ ID NO: 49730 - protein, 79 aa, Homo sapiens
  Payload ID: 9945
  Gene Symbol: MED16
  Gene Name: mediator complex subunit 16
  ENSP ID: ENSP00000478286
  MOD_RES (1)..(1): Any amino acid
XATLQLDGLARAPGQPKIDHLRRLHLGACPTEECKACTRCGCVTMLKSPNRTTAVKQWEQRWIKNCLCGLLKAVGRTPA

SEQ ID NO: 49731 - protein, 219 aa, Homo sapiens
  Payload ID: 9945
  Gene Symbol: MED16
  Gene Name: mediator complex subunit 16
  ENSP ID: ENSP00000479411
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCGGLWWRVPLSYP

SEQ ID NO: 49732 - protein, 194 aa, Homo sapiens
  Payload ID: 9945
  Gene Symbol: MED16
  Gene Name: mediator complex subunit 16
  ENSP ID: ENSP00000480766
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSLLRPHFLNTPDKSPGDRLTEICTKITDVDIDKVMINLKTEEFVL

SEQ ID NO: 49733 - protein, 135 aa, Homo sapiens [sequence omitted]

SEQ ID NO: 49734 - protein, 371 aa, Homo sapiens
  Payload ID: 9945
  Gene Symbol: MED16
  Gene Name: mediator complex subunit 16
  ENSP ID: ENSP00000487810
  MOD_RES (1)..(1): Any amino acid
XLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQVAMRAQRASRTRRWWMNAACCPASCLSPAWTGCQPATAWSAACSPSSPFVCSLAGRPRCLAVLPPCSSTASPGPQASPRSTTCGGCTLALAPRRNARPAPGAAVSPCSSRPTEPRR

SEQ ID NO: 49735 - protein, 497 aa, Homo sapiens
  Payload ID: 9945
  Gene Symbol: MED16
  Gene Name: mediator complex subunit 16
  ENSP ID: ENSP00000488309
  MOD_RES (1)..(1): Any amino acid
XLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLAVEGRGPDACVTSRASEEAPAFVQLGPQSTHHSPRTPRSLDHLHPKDRP

SEQ ID NO: 49736 - protein, 480 aa, Homo sapiens
  Payload ID: 9945
  Gene Symbol: MED16
  Gene Name: mediator complex subunit 16
  ENSP ID: ENSP00000488368
  MOD_RES (1)..(1): Any amino acid
XLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICFPSTGPCSVWVLLGWQPLPGRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYP

SEQ ID NO: 49737 - protein, 45 aa, Homo sapiens
  Payload ID: 9945
  Gene Symbol: MED16
  Gene Name: mediator complex subunit 16
  ENSP ID: ENSP00000488370
SLLRPHFLNTPDKSPGDRLTEICTKITDVDIDKVMINLKTEEFVL

SEQ ID NO: 49738 - protein, 226 aa, Homo sapiens
  Payload ID: 9945
  Gene Symbol: MED16
  Gene Name: mediator complex subunit 16
  ENSP ID: ENSP00000488448
  MOD_RES (1)..(1): Any amino acid
XLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVL

SEQ ID NO: 49739 - protein, 283 aa, Homo sapiens
  Payload ID: 9945
  Gene Symbol: MED16
  Gene Name: mediator complex subunit 16
  ENSP ID: ENSP00000488455
  MOD_RES (1)..(1): Any amino acid
XLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQPSPTSEPSPTSEPSPPSEPSPTSEPSSP

SEQ ID NO: 49740 - protein, 157 aa, Homo sapiens
  Payload ID: 9945
  Gene Symbol: MED16
  Gene Name: mediator complex subunit 16
  ENSP ID: ENSP00000488625
  MOD_RES (1)..(1): Any amino acid
XLALAFHDGSVHIVHRLSLQTMAVFYSSAAPRPVDEPAMKRPRTAGPAVHLKAMQLSWTSLALVGIDSHGKVLSTRILAMKASLCKLSPCTVTRVCDYHTKLFLIAISSTLKSLLRPHFLNTPDKSPGDRLTEICTKITDVDIDKVMINLKTEEFVL

SEQ ID NO: 49741 - protein, 79 aa, Homo sapiens; identical to SEQ ID NO: 49730
  Payload ID: 9945
  Gene Symbol: MED16
  Gene Name: mediator complex subunit 16
  ENSP ID: ENSP00000488682
  MOD_RES (1)..(1): Any amino acid

SEQ ID NO: 49742 - protein, 461 aa, Homo sapiens
  Payload ID: 9945
  Gene Symbol: MED16
  Gene Name: mediator complex subunit 16
  ENSP ID: ENSP00000488787
  MOD_RES (1)..(1): Any amino acid
XLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYP

SEQ ID NO: 49743 - protein, 651 aa, Homo sapiens
  Payload ID: 9946
  Gene Symbol: MED17
  Gene Name: mediator complex subunit 17
  Uniprot ID: Q9NVC6
  ENSP ID: ENSP00000251871
MSGVRAVRISIESACEKQVHEVGLDGTETYLPPLSMSQNLARLAQRIDFSQGSGSEEEEAAGTEGDAQEWPGAGSSADQDDEEGVVKFQPSLWPWDSVRNNLRSALTEMCVLYDVLSIVRDKKFMTLDPVSQDALPPKQNPQTLQLISKKKSLAGAAQILLKGAERLTKSVTENQENKLQRDFNSELLRLRQHWKLRKVGDKILGDLSYRSAGSLFPHHGTFEVIKNTDLDLDKKIPEDYCPLDVQIPSDLEGSAYIKVSIQKQAPDIGDLGTVNLFKRPLPKSKPGSPHWQTKLEAAQNVLLCKEIFAQLSREAVQIKSQVPHIVVKNQIISQPFPSLQLSISLCHSSNDKKSQKFATEKQCPEDHLYVLEHNLHLLIREFHKQTLSSIMMPHPASAPFGHKRMRLSGPQAFDKNEINSLQSSEGLLEKIIKQAKHIFLRSRAAATIDSLASRIEDPQIQAHWSNINDVYESSVKVLITSQGYEQICKSIQLQLNIGVEQIRVVHRDGRVITLSYQEQELQDFLLSQMSQHQVHAVQQLAKVMGWQVLSFSNHVGLGPIESIGNASAITVASPSGDYAISVRNGPESGSKIMVQFPRNQCKDLPKSDVLQDNKWSHLRGPFKEVQWNKMEGRNFVYKMELLMSALSPCLL

SEQ ID NO: 49744 - protein, 231 aa, Homo sapiens
  Payload ID: 9946
  Gene Symbol: MED17
  Gene Name: mediator complex subunit 17
  ENSP ID: ENSP00000431524
MSGVRAVRISIESACEKQVHEVGLDGTETYLPPLSMSQNLARLAQRIDFSQGSGSEEEEAAGTEGDAQEWPGAGSSADQDDEEGVVKFQPSLWPWDSVRNNLRSALTEMCVLYDVLSIVRDKKFMTLDPVSQDALPPKQDRGLAIYKERNGSTLRGDPNRLDRVDAMNPQTLQLISKKKSLAGAAQILLKGAERLTKSVTENQENKLQRDFNSELLRLRQHWKLRKVGDKI

SEQ ID NO: 49745 - protein, 266 aa, Homo sapiens
  Payload ID: 9946
  Gene Symbol: MED17
  Gene Name: mediator complex subunit 17
  ENSP ID: ENSP00000433090
MSGVRAVRISIESACEKQVHEVGLDGTETYLPPLSMSQNLARLAQRIDFSQGSGSEEEEAAGTEGDAQEWPGAGSSADQDDEEGVVKFQPSLWPWDSVRNNLRSALTEMCVLYDVLSIVRDKKFMTLDPVSQDALPPKQNPQTLQLISKKKSLAGAAQILLKGAERLTKSVTENQENKLQRDFNSELLRLRQHWKLRKVGDKILGDLSYRSAGSLFPHHGTFEVIKNTDLDLDKKIPEDYCPLDVQIPSDLEGSAYIKVFVKIFFK

SEQ ID NO: 49746 - protein, 143 aa, Homo sapiens
  Payload ID: 9946
  Gene Symbol: MED17
  Gene Name: mediator complex subunit 17
  ENSP ID: ENSP00000433626
MCVLYDVLSIVRDKKFMTLDPVSQDALPPKQNPQTLQLISKKKSLAGAAQILLKGAERLTKSVTENQENKLQRDFNSELLRLRQHWKLRKVGDKILGDLSYRSAGSLFPHHGTFEVIKNTDLDLDKKIPEDYCPLDVQIPSDL

SEQ ID NO: 49747 - protein, 145 aa, Homo sapiens
  Payload ID: 9946
  Gene Symbol: MED17
  Gene Name: mediator complex subunit 17
  Uniprot ID: Q9NVC6
  ENSP ID: ENSP00000434459
MSGVRAVRISIESACEKQVHEVGLDGTETYLPPLSMSQNLARLAQRIDFSQGSGSEEEEAAGTEGDAQEWPGAGSSADQDDEEGVVKFQPSLWPWDSVRNNLRSALTEMCVLYDVLSIVRDKKFMTLDPVSQDALPPKQVFVDFN

SEQ ID NO: 49748 - protein, 208 aa, Homo sapiens [sequence omitted]

SEQ ID NO: 49749 - protein, 208 aa, Homo sapiens [sequence omitted]

SEQ ID NO: 49750 - protein, 194 aa, Homo sapiens
  Payload ID: 9948
  Gene Symbol: MED19
  Gene Name: mediator complex subunit 19
  Uniprot ID: A0JLT2
  ENSP ID: ENSP00000337340
MENFTALFGAQADPPPPPTALGFGPGKPPPPPPPPAGGGPGTAPPPTAATAPPGADKSGAGCGPFYLMRELPGSTELTGSTNLITHYNLEQAYNKFCGKKVKEKLSNFLPDLPGMIDLPGSHDNSSLRSLIEKPPILSSSFNPITGTMLAGFRLHTGPLPEQCRLMHIQPPKKKNKHKHKQSRTQDPVPPGKPS

SEQ ID NO: 49751 - protein, 244 aa, Homo sapiens
  Payload ID: 9948
  Gene Symbol: MED19
  Gene Name: mediator complex subunit 19
  ENSP ID: ENSP00000416227
MENFTALFGAQADPPPPPTALGFGPGKPPPPPPPPAGGGPGTAPPPTAATAPPGADKSGAGCGPFYLMRELPGSTELTGSTNLITHYNLEQAYNKFCGKKVKEKLSNFLPDLPGMIDLPGSHDNSSLRSLIEKPPILSSSFNPITGTMLAGFRLHTGPLPEQCRLMHIQPPKKKNKHKHKQSRTQDPVPPETPSDSDHKKKKKKKEEDPERKRKKKEKKKKKNRHSPDHPGMGSSQASSSSSLR

SEQ ID NO: 49752 - protein, 212 aa, Homo sapiens
  Payload ID: 9949
  Gene Symbol: MED20
  Gene Name: mediator complex subunit 20
  Uniprot ID: Q9H944
  ENSP ID: ENSP00000265350
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPSARGISVEVEYGPCVVASDCWSLLLEFLQSFLGSHTPGAPAVFGNRHDAVYGPADTMVQYMELFNKIRKQQQVPVAGIR

SEQ ID NO: 49753 - protein, 140 aa, Homo sapiens
  Payload ID: 9949
  Gene Symbol: MED20
  Gene Name: mediator complex subunit 20
  ENSP ID: ENSP00000377795
MPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPSARGISVEVEYGPCV

SEQ ID NO: 49754 - protein, 145 aa, Homo sapiens
  Payload ID: 9949
  Gene Symbol: MED20
  Gene Name: mediator complex subunit 20
  ENSP ID: ENSP00000386668
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPSARGISVEVRPW

SEQ ID NO: 49755 - protein, 123 aa, Homo sapiens
  Payload ID: 9949
  Gene Symbol: MED20
  Gene Name: mediator complex subunit 20
  Uniprot ID: Q9H944
  ENSP ID: ENSP00000386816
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRWSMAPVW

SEQ ID NO: 49756 - protein, 60 aa, Homo sapiens
  Payload ID: 9949
  Gene Symbol: MED20
  Gene Name: mediator complex subunit 20
  ENSP ID: ENSP00000403061
MMEMFSNNSVQYTSPSHLWLWATVLNSSSSQSCVSQMPVAEGKSVQQTVELLTRKLEMLG

SEQ ID NO: 49757 - protein, 211 aa, Homo sapiens
  Payload ID: 9949
  Gene Symbol: MED20
  Gene Name: mediator complex subunit 20
  ENSP ID: ENSP00000484159
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPVPGISVEVEYGPCVVASDCWSLLLEFLQSFLGSHTPGAPAVFGNRHDAVYGPADTMVQYMELFNKIRKQQQVPVAGIR

SEQ ID NO: 49758 - protein, 144 aa, Homo sapiens
  Payload ID: 9950
  Gene Symbol: MED21
  Gene Name: mediator complex subunit 21
  Uniprot ID: Q13503
  ENSP ID: ENSP00000282892
MADRLTQLQDAVNSLADQFCNAIGVLQQCGPPASFNNIQTAINKDQPANPTEEYAQLFAALIARTAKDIDVLIDSLPSEESTAALQAASLYKLEEENHEAATCLEDVVYRGDMLLEKIQSALADIAQSQLKTRSGTHSQSLPDS

SEQ ID NO: 49759 - protein, 159 aa, Homo sapiens
  Payload ID: 9950
  Gene Symbol: MED21
  Gene Name: mediator complex subunit 21
  ENSP ID: ENSP00000442126
MADRLTQLQDAVNSLADQFCNAIGVLQQCGPPASFNNIQTAINKDQPANPTEEYAQLFAALIARTAKDIDVLIDSLPSEESTAALQAASLYKLEEENHEAATCLEDVVYRGDMLLEKIQSALADIAQSQLKTRSGEVSVTQAEVQFCDHGSLQLHPGFR

SEQ ID NO: 49760 - protein, 87 aa, Homo sapiens
  Payload ID: 9950
  Gene Symbol: MED21
  Gene Name: mediator complex subunit 21
  ENSP ID: ENSP00000444297
MADRLTQLQDAVNSVRNFIRLASVFLFLEVKQGRKGAQEAKLESGERTERQGFGIKRSLGRRHRELGGLRPAAGRCLKVREGADSFA

SEQ ID NO: 49761 - protein, 200 aa, Homo sapiens
  Payload ID: 9951
  Gene Symbol: MED22
  Gene Name: mediator complex subunit 22
  Uniprot ID: Q15528
  ENSP ID: ENSP00000342343
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSSSSSLCEANDLPLCEAYGRLDLDTDSADGLSAPLLASPEPSAGPLQVAAPAHSHAGGPGPTEHA

SEQ ID NO: 49762 - protein, 134 aa, Homo sapiens
  Payload ID: 9951
  Gene Symbol: MED22
  Gene Name: mediator complex subunit 22
  ENSP ID: ENSP00000361067
MAQQRALPQSKETLLQSYNKRLKDDIKSIMDNFTEIIKTAKIEDETQVSRATQGEQDNYEMHVRAGESLMKLVSDLKQFLILNDFPSVNEAIDQRNQQLRTLQEECDRKLITLRDEISIDLYELEEEYYSSRYK

SEQ ID NO: 49763 - protein, 137 aa, Homo sapiens
  Payload ID: 9951
  Gene Symbol: MED22
  Gene Name: mediator complex subunit 22
  ENSP ID: ENSP00000394781
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSS

SEQ ID NO: 49764 - protein, 111 aa, Homo sapiens
  Payload ID: 9951
  Gene Symbol: MED22
  Gene Name: mediator complex subunit 22
  ENSP ID: ENSP00000404178
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEE

SEQ ID NO: 49765 - protein, 135 aa, Homo sapiens
  Payload ID: 9951
  Gene Symbol: MED22
  Gene Name: mediator complex subunit 22
  ENSP ID: ENSP00000420815
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYY

SEQ ID NO: 49766 - protein, 140 aa, Homo sapiens
  Payload ID: 9951
  Gene Symbol: MED22
  Gene Name: mediator complex subunit 22
  Uniprot ID: Q15528
  ENSP ID: ENSP00000478773
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSSRYK

SEQ ID NO: 49767 - protein, 140 aa, Homo sapiens; identical to SEQ ID NO: 49766
  Payload ID: 9951
  Gene Symbol: MED22
  Gene Name: mediator complex subunit 22
  Uniprot ID: Q15528
  ENSP ID: ENSP00000481493

SEQ ID NO: 49768 - protein, 200 aa, Homo sapiens; identical to SEQ ID NO: 49761
  Payload ID: 9951
  Gene Symbol: MED22
  Gene Name: mediator complex subunit 22
  Uniprot ID: Q15528
  ENSP ID: ENSP00000482438

SEQ ID NO: 49769 - protein, 111 aa, Homo sapiens; identical to SEQ ID NO: 49764
  Payload ID: 9951
  Gene Symbol: MED22
  Gene Name: Mediator complex subunit 22
  ENSP ID: ENSP00000485703

SEQ ID NO: 49770 - protein, 140 aa, Homo sapiens; identical to SEQ ID NO: 49766
  Payload ID: 9951
  Gene Symbol: MED22
  Gene Name: Mediator complex subunit 22
  ENSP ID: ENSP00000485715

SEQ ID NO: 49771 - protein, 200 aa, Homo sapiens; identical to SEQ ID NO: 49761
  Payload ID: 9951
  Gene Symbol: MED22
  Gene Name: Mediator complex subunit 22
  ENSP ID: ENSP00000485880

SEQ ID NO: 49772 - protein, 135 aa, Homo sapiens; identical to SEQ ID NO: 49765
  Payload ID: 9951
  Gene Symbol: MED22
  Gene Name: Mediator complex subunit 22
  ENSP ID: ENSP00000486136

SEQ ID NO: 49773 - protein, 140 aa, Homo sapiens; identical to SEQ ID NO: 49766
  Payload ID: 9951
  Gene Symbol: MED22
  Gene Name: Mediator complex subunit 22
  ENSP ID: ENSP00000486722

SEQ ID NO: 49774 - protein, 134 aa, Homo sapiens; identical to SEQ ID NO: 49762
  Payload ID: 9951
  Gene Symbol: MED22
  Gene Name: Mediator complex subunit 22
  ENSP ID: ENSP00000487129

SEQ ID NO: 49775 - protein, 137 aa, Homo sapiens; identical to SEQ ID NO: 49763
  Payload ID: 9951
  Gene Symbol: MED22
  Gene Name: Mediator complex subunit 22
  ENSP ID: ENSP00000487276

SEQ ID NO: 49776 - protein, 200 aa, Homo sapiens; identical to SEQ ID NO: 49761
  Payload ID: 9951
  Gene Symbol: MED22
  Gene Name: Mediator complex subunit 22
  ENSP ID: ENSP00000487580

SEQ ID NO: 49777 - protein, 1365 aa, Homo sapiens
  Payload ID: 9952
  Gene Symbol: MED23
  Gene Name: mediator complex subunit 23
  Uniprot ID: Q9ULK4
  ENSP ID: ENSP00000346588
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQTLNIAQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQ

SEQ ID NO: 49778 - protein, 886 aa, Homo sapiens
  Payload ID: 9952
  Gene Symbol: MED23
  Gene Name: mediator complex subunit 23
  Uniprot ID: Q9ULK4
  ENSP ID: ENSP00000357032
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQTLNIAQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLVRINTFLSLFS

SEQ ID NO: 49779 - protein, 1374 aa, Homo sapiens
  Payload ID: 9952
  Gene Symbol: MED23
  Gene Name: mediator complex subunit 23
  ENSP ID: ENSP00000357037
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQTLNIAQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVKKIICNLKPALKLRLRFITHISKMEPAAVPPQAMNSGSPAPQSNQVPVSLPVTQ

SEQ ID NO: 49780 - protein, 1364 aa, Homo sapiens
  Payload ID: 9952
  Gene Symbol: MED23
  Gene Name: mediator complex subunit 23
  Uniprot ID: Q9ULK4
  ENSP ID: ENSP00000357039
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVDTLT

SEQ ID NO: 49781 - protein, 1368 aa, Homo sapiens
  Payload ID: 9952
  Gene Symbol: MED23
  Gene Name: mediator complex subunit 23
  Uniprot ID: Q9ULK4
  ENSP ID: ENSP00000357047
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVPVSLPVTQ

SEQ ID NO: 49782 - protein, 475 aa, Homo sapiens
  Payload ID: 9952
  Gene Symbol: MED23
  Gene Name: mediator complex subunit 23
  Uniprot ID: Q9ULK4
  ENSP ID: ENSP00000445072
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHESAFANCFQITCMGDLTHTP

SEQ ID NO: 49783 - protein, 976 aa, Homo sapiens
  Payload ID: 9953
  Gene Symbol: MED24
  Gene Name: mediator complex subunit 24
  Uniprot ID: O75448
  ENSP ID: ENSP00000348610
MKVVNLKQAILQAWKERWSDYQWAINMKKFFPKGATWDILNLADALLEQAMIGPSPNPLILSYLKYAISSQFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 49784 - protein, 1014 aa, Homo sapiens
  Payload ID: 9953
  Gene Symbol: MED24
  Gene Name: mediator complex subunit 24
  ENSP ID: ENSP00000377684
MSFSLAPFLSPQSWPPPLPPAQSEIMKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 49785 - protein, 976 aa, Homo sapiens; identical to SEQ ID NO: 49783
  Payload ID: 9953
  Gene Symbol: MED24
  Gene Name: mediator complex subunit 24
  Uniprot ID: O75448
  ENSP ID: ENSP00000377685

SEQ ID NO: 49786 - protein, 989 aa, Homo sapiens
  Payload ID: 9953
  Gene Symbol: MED24
  Gene Name: mediator complex subunit 24
  Uniprot ID: O75448
  ENSP ID: ENSP00000377686
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 49787 - protein, 301 aa, Homo sapiens
  Payload ID: 9953
  Gene Symbol: MED24
  Gene Name: mediator complex subunit 24
  ENSP ID: ENSP00000392276
MSFSLAPFLSPQSWPPPLPPAQSEIMKVVNLKQAILQAWKERWSDYQWAINMKKFFPKGATWDILNLADALLEQAMIGPSPNPLILSYLKYAISSQFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKAC

SEQ ID NO: 49788 - protein, 292 aa, Homo sapiens
  Payload ID: 9953
  Gene Symbol: MED24
  Gene Name: mediator complex subunit 24
  ENSP ID: ENSP00000393464
VYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPRSSLGSPCTSYLRWVKVGLGHPRGAPLLHSAGCFPALHLLRPTADRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 49789 - protein, 84 aa, Homo sapiens
  Payload ID: 9953
  Gene Symbol: MED24
  Gene Name: mediator complex subunit 24
  ENSP ID: ENSP00000435760
  MOD_RES (1)..(1): Any amino acid
XGQASTRQKKRHREDIEDYISLFPLDDVQPSKLMRLLSSNEDDANILSSPTDRSMSSSLSASQLHTVNMRDPLNRVLVPPSPRV

SEQ ID NO: 49790 - protein, 189 aa, Homo sapiens
  Payload ID: 9953
  Gene Symbol: MED24
  Gene Name: mediator complex subunit 24
  ENSP ID: ENSP00000438630
MSFSLAPFLSPQSWPPPLPPAQSEIMKVVNLKQAILQAWKERWSDYQWAINMKKFFPKGATWDILNLADALLEQAMIGPSPNPLILSYLKYAISSQFDDFSRDLCVQALLDIMDMFCDRLSCHGKAEECIGLCRALLSALHWLLRCTAASAERLREGLEAGTPAAGEKQLAMCLQRLEKTLSSTKNRAL

SEQ ID NO: 49791 - protein, 163 aa, Homo sapiens
  Payload ID: 9953
  Gene Symbol: MED24
  Gene Name: mediator complex subunit 24
  ENSP ID: ENSP00000438767
MSFSLAPFLSPQSWPPPLPPAQSEIMKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAAS

SEQ ID NO: 49792 - protein, 100 aa, Homo sapiens
  Payload ID: 9953
  Gene Symbol: MED24
  Gene Name: mediator complex subunit 24
  ENSP ID: ENSP00000439148
MKVVNLKQAILQAWKERWSDYQWAINMKKFFPKGATWDILNLADALLEQAMIGPSPNPLILSYLKYAISSQMVSYSSVLTAISKLSRQSRGMHRTVPSPS

SEQ ID NO: 49793 - protein, 1008 aa, Homo sapiens
  Payload ID: 9953
  Gene Symbol: MED24
  Gene Name: mediator complex subunit 24
  ENSP ID: ENSP00000440100
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASLHTSQGLGQGGTRANQPTASWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 49794 - protein, 791 aa, Homo sapiens
  Payload ID: 9953
  Gene Symbol: MED24
  Gene Name: mediator complex subunit 24
  ENSP ID: ENSP00000443344
MIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIE

SEQ ID NO: 49795 - protein, 176 aa, Homo sapiens
  Payload ID: 9953
  Gene Symbol: MED24
  Gene Name: mediator complex subunit 24
  ENSP ID: ENSP00000462539
MIQEWLQVEGLRLWLQAQNDSRGAGKAPFLSPQSWPPPLPPAQSEIMKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHW

SEQ ID NO: 49796 - protein, 159 aa, Homo sapiens
  Payload ID: 9953
  Gene Symbol: MED24
  Gene Name: mediator complex subunit 24
  ENSP ID: ENSP00000462646
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLA

SEQ ID NO: 49797 - protein, 138 aa, Homo sapiens
  Payload ID: 9953
  Gene Symbol: MED24
  Gene Name: mediator complex subunit 24
  ENSP ID: ENSP00000463043
AISSQFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASLHTSQGLGQGGTRANQPTATGFWPPSASLS

SEQ ID NO: 49798 - protein, 143 aa, Homo sapiens
  Payload ID: 9953
  Gene Symbol: MED24
  Gene Name: mediator complex subunit 24
  ENSP ID: ENSP00000463480
MSFSLAPFLSPQSWPPPLPPAQSEIMKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECI

SEQ ID NO: 49799 - protein, 57 aa, Homo sapiens
  Payload ID: 9953
  Gene Symbol: MED24
  Gene Name: mediator complex subunit 24
  ENSP ID: ENSP00000463484
  MOD_RES (1)..(1): Any amino acid
XLLEQAMIGPSPNPLILSYLKYAISSQMVSYSSVLTAINSTGFGEVEEVLSWRQGLH

SEQ ID NO: 49800 - protein, 138 aa, Homo sapiens
  Payload ID: 9953
  Gene Symbol: MED24
  Gene Name: mediator complex subunit 24
  ENSP ID: ENSP00000463528
MSFSLAPFLSPQSWPPPLPPAQSEIMKVVNLKQAILQAWKERWSDYQWAINMKKFFPKGATWDILNLADALLEQAMIGPSPNPLILSYLKYAISSQFDDFSRDLCVQALLDIMDMFCDRLSCHGKAEECIGLCRALLS

SEQ ID NO: 49801 - protein, 23 aa, Homo sapiens
  Payload ID: 9953
  Gene Symbol: MED24
  Gene Name: mediator complex subunit 24
  ENSP ID: ENSP00000463724
  MOD_RES (1)..(1): Any amino acid
XLNEFTTYGSEESSDSVRVAHRS

SEQ ID NO: 49802 - protein, 638 aa, Homo sapiens
  Payload ID: 9953
  Gene Symbol: MED24
  Gene Name: mediator complex subunit 24
  ENSP ID: ENSP00000463751
MVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKCSSGLDFLSCPQTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPY

SEQ ID NO: 49803 - protein, 54 aa, Homo sapiens
  Payload ID: 9953
  Gene Symbol: MED24
  Gene Name: mediator complex subunit 24
  ENSP ID: ENSP00000464225
MKVVNLKQAILQAWKERWSDYQWAINMKKFFPKGATWDILNLADALLEQAMIGP

SEQ ID NO: 49804 - protein, 137 aa, Homo sapiens
  Payload ID: 9953
  Gene Symbol: MED24
  Gene Name: mediator complex subunit 24
  ENSP ID: ENSP00000482676
MKVVNLKQAILQAWKERWSDYQWAINMKKFFPKGATWDILNLADALLEQAMIGPSPNPLILSYLKYAISSQMVSYSSVLTAISKFDDFSRDHKPSGHPCVRPPQPRSSLTSEELSRCKVCMCVCVCVCVCLCVFCNM

SEQ ID NO: 49805 - protein, 747 aa, Homo sapiens
  Payload ID: 9954
  Gene Symbol: MED25
  Gene Name: mediator complex subunit 25
  Uniprot ID: Q71SY5
  ENSP ID: ENSP00000326767
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPGQMLLSGGPRGPVPQPGLQPSVMEDDILMDLI

SEQ ID NO: 49806 - protein, 534 aa, Homo sapiens
  Payload ID: 9954
  Gene Symbol: MED25
  Gene Name: mediator complex subunit 25
  Uniprot ID: Q71SY5
  ENSP ID: ENSP00000437496
MVPGSEGPARAGSVVADVVFVIEGTANLGPYFEGLRKHYLLPAIEYFNGGPPAETDFGGDVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPGQMLLSGGPRGPVPQPGLQPSVMEDDILMDLI

SEQ ID NO: 49807 - protein, 253 aa, Homo sapiens
  Payload ID: 9954
  Gene Symbol: MED25
  Gene Name: mediator complex subunit 25
  ENSP ID: ENSP00000470027
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPAGPAAQRHGGRHPHGSHLNPQHPI

SEQ ID NO: 49808 - protein, 248 aa, Homo sapiens
  Payload ID: 9954
  Gene Symbol: MED25
  Gene Name: mediator complex subunit 25
  ENSP ID: ENSP00000470692
  MOD_RES (1)..(1): Any amino acid
XEDLHGPHPLRPERLRQRHPAGHHQPQAGPAAEAGAAAARNGGTAGTPRAGAHSGGPSQALTESAPAPPTAAPASGYRRGLWGHGAAPAPRYCPAPARCPSRPSWSSFWPTPSWTHPSAPEPWGQPSAAKPPPQPTTAADWGAPTPGLPPPPPATRGSCAAASAAPGPGAAPVGAPTPASTTCPVLARTTSPSGSTASGKTKERRRGPCVSRKMGASLFLCGSEEHAYVFNMQTNRVCVERIQPETPL

SEQ ID NO: 49809 - protein, 180 aa, Homo sapiens
  Payload ID: 9954
  Gene Symbol: MED25
  Gene Name: mediator complex subunit 25
  ENSP ID: ENSP00000478074
MVPGSEGPARAGSVVADVVFVIEGTANLGPYFEGLRKHYLLPAIEYFNGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPGQMLLSGGPRGPVPQPGLQPSVMEDDILMDLI

SEQ ID NO: 49810 - protein, 259 aa, Homo sapiens
  Payload ID: 9954
  Gene Symbol: MED25
  Gene Name: mediator complex subunit 25
  ENSP ID: ENSP00000479851
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPGLAGAAAASDRCEPGPEAHGAGSGTRAACWGWLSPRPPPVKAASPPASRRTLRCQVRCC

SEQ ID NO: 49811 - protein, 482 aa, Homo sapiens
  Payload ID: 9954
  Gene Symbol: MED25
  Gene Name: mediator complex subunit 25
  ENSP ID: ENSP00000480731
MVPGSEGPARAGSVVADVVFVIEGTANLGPYFEGLRKHYLLPAIEYFNGGPPAPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPGQMLLSGGPRGPVPQPGLQPSVMEDDILMDLI

SEQ ID NO: 49812 - protein, 233 aa, Homo sapiens
  Payload ID: 9954
  Gene Symbol: MED25
  Gene Name: mediator complex subunit 25
  ENSP ID: ENSP00000482155
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPASLHHLQPPGAPALLPPPHQGLGQPQLGPPLLHPPPAQSWPAQLPPRAPLPGQMLLSGGPRGPVPQPGLQPSVMEDDILMDLI

SEQ ID NO: 49813 - protein, 397 aa, Homo sapiens
  Payload ID: 9954
  Gene Symbol: MED25
  Gene Name: mediator complex subunit 25
  ENSP ID: ENSP00000482659
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPALLPPPHQGLGQPQLGPPLLHPPPAQSWPAQLPPRAPLPGQMLLSGGPRGPVPQPGLQPSVMEDDILMDLI

SEQ ID NO: 49814 - protein, 250 aa, Homo sapiens
  Payload ID: 9954
  Gene Symbol: MED25
  Gene Name: mediator complex subunit 25
  ENSP ID: ENSP00000483584
MLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPIFGPRTLGPTLSCEASSSTHHRRRLGCPHPRPPSTTSSHQGLLRCCLRRQGLGQPQLGPHSCIHHLPSPGPHNFPLGLHCQVRGPGGGQRSGLSVPAAPGLEHQDRVLLGSKDIGSKNEGSPMAFAEL

SEQ ID NO: 49815 - protein, 482 aa, Homo sapiens; identical to SEQ ID NO: 49811
  Payload ID: 9954
  Gene Symbol: MED25
  Gene Name: mediator complex subunit 25
  ENSP ID: ENSP00000484882

SEQ ID NO: 49816 - protein, 600 aa, Homo sapiens
  Payload ID: 9955
  Gene Symbol: MED26
  Gene Name: mediator complex subunit 26
  Uniprot ID: O95402
  ENSP ID: ENSP00000263390
MTAAPASPQQIRDRLLQAIDPQSNIRNMVAVLEVISSLEKYPITKEALEETRLGKLINDVRKKTKNEELAKRAKKLLRSWQKLIEPAHQHEAALRGLAGATGSANGGAHNCRPEVGAAGPPRSIHDLKSRNDLQRLPGQRLDRLGSRKRRGDQRDLGHPGPPPKVSKASHDPLVPNSSPLPTNGISGSPESFASSLDGSGHAGPEGSRLERDENDKHSGKIPVNAVRPHTSSPGLGKPPGPCLQPKASVLQQLDRVDETPGPPHPKGPPRCSFSPRNSRHEGSFARQQSLYAPKGSVPSPSPRPQALDATQVPSPLPLAQPSTPPVRRLELLPSAESPVCWLEQPESHQRLAGPGCKAGLSPAEPLLSRAGFSPDSSKADSDAASSGGSDSKKKKRYRPRDYTVNLDGQVAEAGVKPVRLKERKLTFDPMTRQIKPLTQKEPVRADSPVHMEQQSRTELDKQEAKASLQSPFEQTNWKELSRNEIIQSYLSRQSSLLSSSGAQTPGAHHFMSEYLKQEESTRQGARQLHVLVPQSPPTDLPGLTREVTQDDLDRIQASQWPGVNGCQDTQGNWYDWTQCISLDPHGDDGRLNILPYVCLD

SEQ ID NO: 49817 - protein, 110 aa, Homo sapiens
  Payload ID: 9955
  Gene Symbol: MED26
  Gene Name: mediator complex subunit 26
  ENSP ID: ENSP00000469434
MVAVLEVISSLEKYPITKEALEETRLGKLINDVRKKTKNEELAKRAKKLLRSWQKLIEPAHQHEAALRGLAGATGSANGGAHNCRPEVGAAGPPRSIHDLKSRNDLQRLP

SEQ ID NO: 49818 - protein, 213 aa, Homo sapiens
  Payload ID: 9955
  Gene Symbol: MED26
  Gene Name: mediator complex subunit 26
  ENSP ID: ENSP00000471040
MPLNFRQIGGPAPKTERSRPNASGAEVEKPPRRRRFATSGFPSYGGRLLPEALCRLTFSRSGSRVAVQTPALPPHPFPHPLRGGGAAATPPDSDDPSARRITTWTSGSLALTKNSAAAQPATPVPQSRAGKALPEEGFSRRPPRPEIRNMVAVLEVISSLEKYPITKEALEETRLGKLINDVRKKTKNEELAKRAKKLLRSWQKLIEPAHQHE

SEQ ID NO: 49819 - protein, 54 aa, Homo sapiens
  Payload ID: 9955
  Gene Symbol: MED26
  Gene Name: mediator complex subunit 26
  ENSP ID: ENSP00000472706
MVAVLEVISSLEKYPITKEALEETRLGKLINDVRKKTKNEELAKRAKKLLRSWQ

SEQ ID NO: 49820 - protein, 82 aa, Homo sapiens
  Payload ID: 9955
  Gene Symbol: MED26
  Gene Name: mediator complex subunit 26
  ENSP ID: ENSP00000472880
MTAAPASPQQIRDRLLQAIDPQSNIRNMVAVLEVISSLEKYPITKEALEVSIPDPSIWEGRTGGRGWYQPGPSAASGSISVF

SEQ ID NO: 49821 - protein, 92 aa, Homo sapiens
  Payload ID: 9955
  Gene Symbol: MED26
  Gene Name: mediator complex subunit 26
  Uniprot ID: O95402
  ENSP ID: ENSP00000484490
MTAAPASPQQIRDRLLQAIDPQSNIRNMVAVLEVISSLEKYPITKEALEETRLGKLINDVRKKTKNEELAKRAKKLPGWQWACRPRGQPPGA

SEQ ID NO: 49822 - protein, 311 aa, Homo sapiens
  Payload ID: 9956
  Gene Symbol: MED27
  Gene Name: mediator complex subunit 27
  Uniprot ID: Q6P2C8
  ENSP ID: ENSP00000292035
MADVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKLQYHAGLASGLLNQQSLKRSANQMGVSAKRRPKAQPTTLVLPPQYVDDVISRIDRMFPEMSIHLSRPNGTSAMLLVTLGKVLKVIVVMRSLFIDRTIVKGYNENVYTEDGKLDIWSKSNYQVFQKVTDHATTALLHYQLPQMPDVVVRSFMTWLRSYIKLFQAPCQRCGKFLQDGLPPTWRDFRTLEAFHDTCRQ

SEQ ID NO: 49823 - protein, 275 aa, Homo sapiens
  Payload ID: 9956
  Gene Symbol: MED27
  Gene Name: mediator complex subunit 27
  Uniprot ID: Q6P2C8
  ENSP ID: ENSP00000349530
MADVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKLQYHAGLASGLLNQQSLKRSANQMGVSAKRRPKAQPTTLVLPPQYVDDVISRIDRMFPEMSIHLSRPNGTSAMLLLDIWSKSNYQVFQKVTDHATTALLHYQLPQMPDVVVRSFMTWLRSYIKLFQAPCQRCGKFLQDGLPPTWRDFRTLEAFHDTCRQ

SEQ ID NO: 49824 - protein, 130 aa, Homo sapiens
  Payload ID: 9956
  Gene Symbol: MED27
  Gene Name: mediator complex subunit 27
  Uniprot ID: Q6P2C8
  ENSP ID: ENSP00000477136
MADVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKKEQLSIPRIFHWKV

SEQ ID NO: 49825 - protein, 178 aa, Homo sapiens
  Payload ID: 9957
  Gene Symbol: MED28
  Gene Name: mediator complex subunit 28
  Uniprot ID: Q9H204
  ENSP ID: ENSP00000237380
MAAPLGGMFSGQPPGPPQAPPGLPGQASLLQAAPGAPRPSSSTLVDELESSFEACFASLVSQDYVNGTDQEEIRTGVDQCIQKFLDIARQTECFFLQKRLQLSVQKPEQVIKEDVSELRNELQRKDALVQKHLTKLRHWQQVLEDINVQHKKPADIPQGSLAYLEQASANIPAPLKPT

SEQ ID NO: 49826 - protein, 179 aa, Homo sapiens
  Payload ID: 9957
  Gene Symbol: MED28
  Gene Name: mediator complex subunit 28
  ENSP ID: ENSP00000426529
PLGGMFSGQPPGPPQAPPGLPGQASLLQAAPGAPRPSSSTLVDELESSFEACFASLVSQDYVNGTDQEEIRTGVDQCIQKFLDIARQTECFFLQKRLQLSVQKPEQVIKEDVSELRNELQRKDALVQKHLTKLRHWQQVLEDINVQHKKPADIPQGSLAYLEQASANIPAPLKPTHLTG

SEQ ID NO: 49827 - protein, 192 aa, Homo sapiens
  Payload ID: 9957
  Gene Symbol: MED28
  Gene Name: mediator complex subunit 28
  ENSP ID: ENSP00000483496
MAAPLGGMFSGQPPGPPQAPPGLPGQASLLQAAPGAPRPSSSTLVDELESSFEACFASLVSQDYVNGTDQEEIRTGVDQCIQKFLDIARQTECFFLQKRLQLSVQKPEQVIKEDVSELRNELQRKDALVQKHLTKLRHWQQVLEDINVQHKKPADIPQGSLAYLAGICQHPCTSEANVSKGQRQLAYEWADA

SEQ ID NO: 49828 - protein, 221 aa, Homo sapiens
  Payload ID: 9958
  Gene Symbol: MED29
  Gene Name: mediator complex subunit 29
  ENSP ID: ENSP00000314343
MLKSNGERRSRNALPAVYARKMAASQQQASAASSAAGVSGPSSAGGPGPQQQPQPPAQLVGPAQSGLLQQQQQDFDPVQRYKMLIPQLKESLQTLMKVAAQNLIQNTNIDNGQKSSDGPIQRFDKCLEEFYALCDQLELCLRLAHECLSQSCDSAKHSPTLVPTATKPDAVQPDSLPYPQYLAVIKAQISCAKDIHTALLDCANKVTGKTPAPPAGPGGTL

SEQ ID NO: 49829 - protein, 96 aa, Homo sapiens
  Payload ID: 9958
  Gene Symbol: MED29
  Gene Name: mediator complex subunit 29
  ENSP ID: ENSP00000471101
MLKSNGERRSRNALPAVYARKMAASQQQASAASSAAGVSGPSSAGGPGPQQQPQPPAQLVGPAQSGLLQQQQQDFDPVQRYKMLIPQLKESLQKEQ

SEQ ID NO: 49830 - protein, 114 aa, Homo sapiens
  Payload ID: 9958
  Gene Symbol: MED29
  Gene Name: mediator complex subunit 29
  ENSP ID: ENSP00000471444
MAASQQQASAASSAAGVSGPSSAGGPGPQQQPQPPAQLVGPAQSGLLQQQQQDFDPVQRYKMLIPQLKESLQTLMKVAAQNLIQNTNIDNGQVSLCHPGWTTVARSWLIAALNT

SEQ ID NO: 49831 - protein, 200 aa, Homo sapiens
  Payload ID: 9958
  Gene Symbol: MED29
  Gene Name: mediator complex subunit 29
  Uniprot ID: Q9NX70
  ENSP ID: ENSP00000471802
MAASQQQASAASSAAGVSGPSSAGGPGPQQQPQPPAQLVGPAQSGLLQQQQQDFDPVQRYKMLIPQLKESLQTLMKVAAQNLIQNTNIDNGQKSSDGPIQRFDKCLEEFYALCDQLELCLRLAHECLSQSCDSAKHSPTLVPTATKPDAVQPDSLPYPQYLAVIKAQISCAKDIHTALLDCANKVTGKTPAPPAGPGGTL

SEQ ID NO: 49832 - protein, 196 aa, Homo sapiens
  Payload ID: 9958
  Gene Symbol: MED29
  Gene Name: mediator complex subunit 29
  Uniprot ID: Q9NX70
  ENSP ID: ENSP00000472501
MAASQQQASAASSAAGVSGPSSAGGPGPQQQPQPPAQLVGPAQSGLLQQQQQDFDPVQRYKMLIPQLKESLQTLMKVAAQNLIQNTNIDNGQKSSDGPIQRFDKCLEEFYALCDQLELCLPPSPTQCSLTASPTHSTWRSSKPRFPVPRTFTPPCWTVPTRSRARHPHHLLALGALCEVGDREWGRQWLVGGVQRE

SEQ ID NO: 49833 - protein, 208 aa, Homo sapiens
  Payload ID: 9958
  Gene Symbol: MED29
  Gene Name: mediator complex subunit 29
  ENSP ID: ENSP00000473181
MAASQQQASAASSAAGVSGPSSAGGPGPQQQPQPPAQLVGPAQSGLLQQQQQDFDPVQRYKMLIPQLKESLQTLMKVAAQNLIQNTNIDNGQKSSDGPIQRFDKCLEEFYALCDQLELCLVRSLLDTGAWRMSACHRVVTVPSTLQRWCPQPPSPTQCSLTASPTHSTWRSSKPRFPVPRTFTPPCWTVPTRSRARHPHHLLALGALC

SEQ ID NO: 49834 - protein, 221 aa, Homo sapiens; identical to SEQ ID NO: 49828
  Payload ID: 9958
  Gene Symbol: MED29
  Gene Name: mediator complex subunit 29
  ENSP ID: ENSP00000481733

SEQ ID NO: 49835 - protein, 178 aa, Homo sapiens
  Payload ID: 9959
  Gene Symbol: MED30
  Gene Name: mediator complex subunit 30
  Uniprot ID: Q96HR3
  ENSP ID: ENSP00000297347
MSTPPLAASGMAPGPFAGPQAQQAAREVNTASLCRIGQETVQDIVYRTMEIFQLLRNMQLPNGVTYHTGTYQDRLTKLQDNLRQLSVLFRKLRLVYDKCNENCGGMDPIPVEQLIPYVEEDGSKNDDRAGPPRFASEERREIAEVNKKLKQKNQQLKQIMDQLRNLIWDINAMLAMRN

SEQ ID NO: 49836 - protein, 143 aa, Homo sapiens
  Payload ID: 9959
  Gene Symbol: MED30
  Gene Name: mediator complex subunit 30
  Uniprot ID: Q96HR3
  ENSP ID: ENSP00000431051
MSTPPLAASGMAPGPFAGPQAQQAAREVNTASLCRIGQETVQDIVYRTMEIFQLLRNMQLPNGVTYHTGTYQDRLTKLQDNLRQLSVLFRKLRLVYDKCNENCGGMDPIPVEKLKQKNQQLKQIMDQLRNLIWDINAMLAMRN

SEQ ID NO: 49837 - protein, 131 aa, Homo sapiens
  Payload ID: 9960
  Gene Symbol: MED31
  Gene Name: mediator complex subunit 31
  Uniprot ID: Q9Y3C7
  ENSP ID: ENSP00000225728
MAAAVAMETDDAGNRLRFQLELEFVQCLANPNYLNFLAQRGYFKDKAFVNYLKYLLYWKDPEYAKYLKYPQCLHMLELLQYEHFRKELVNAQCAKFIDEQQILHWQHYSRKRMRLQQALAEQQQQNNTSGK

SEQ ID NO: 49838 - protein, 43 aa, Homo sapiens
  Payload ID: 9960
  Gene Symbol: MED31
  Gene Name: mediator complex subunit 31
  ENSP ID: ENSP00000458248
MAAAVAMETDDAGNRLRFQLELEFVQCLANPNYLNCTLSVYTC

SEQ ID NO: 49839 - protein, 57 aa, Homo sapiens
  Payload ID: 9960
  Gene Symbol: MED31
  Gene Name: mediator complex subunit 31
  ENSP ID: ENSP00000459723
MLELLQYEHFRKELVNAQCAKFIDEQQILHWQHYSRKRMRLQQALAEQQQQNNTSGK

SEQ ID NO: 49840 - protein, 270 aa, Homo sapiens
  Payload ID: 9961
  Gene Symbol: MED4
  Gene Name: mediator complex subunit 4
  Uniprot ID: Q9NPJ6
  ENSP ID: ENSP00000258648
MAASSSGEKEKERLGGGLGVAGGNSTRERLLSALEDLEVLSRELIEMLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 49841 - protein, 224 aa, Homo sapiens
  Payload ID: 9961
  Gene Symbol: MED4
  Gene Name: mediator complex subunit 4
  Uniprot ID: Q9NPJ6
  ENSP ID: ENSP00000367849
MLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 49842 - protein, 238 aa, Homo sapiens
  Payload ID: 9961
  Gene Symbol: MED4
  Gene Name: mediator complex subunit 4
  ENSP ID: ENSP00000413595
MKLLWWCDWLPERSHVFTQRELIEMLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMST

SEQ ID NO: 49843 - protein, 153 aa, Homo sapiens
  Payload ID: 9961
  Gene Symbol: MED4
  Gene Name: mediator complex subunit 4
  ENSP ID: ENSP00000483651
  MOD_RES (1)..(1): Any amino acid
XDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSKMEFHHVGQTGSELLTSSDPPTSASQSAGITGVSHRAWQEPSLLSTEDCLINTSWL

SEQ ID NO: 49844 - protein, 246 aa, Homo sapiens
  Payload ID: 9962
  Gene Symbol: MED6
  Gene Name: mediator complex subunit 6
  Uniprot ID: O75586
  ENSP ID: ENSP00000256379
MAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQ

SEQ ID NO: 49845 - protein, 181 aa, Homo sapiens
  Payload ID: 9962
  Gene Symbol: MED6
  Gene Name: mediator complex subunit 6
  Uniprot ID: O75586
  ENSP ID: ENSP00000394502
MAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQAKAWRKACSSGSNKERGRTYTRNCKT

SEQ ID NO: 49846 - protein, 253 aa, Homo sapiens
  Payload ID: 9962
  Gene Symbol: MED6
  Gene Name: mediator complex subunit 6
  Uniprot ID: O75586
  ENSP ID: ENSP00000413343
MAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVSLFSFYKLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQ

SEQ ID NO: 49847 - protein, 249 aa, Homo sapiens
  Payload ID: 9962
  Gene Symbol: MED6
  Gene Name: mediator complex subunit 6
  ENSP ID: ENSP00000451684
MAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQKAV

SEQ ID NO: 49848 - protein, 257 aa, Homo sapiens
  Payload ID: 9962
  Gene Symbol: MED6
  Gene Name: mediator complex subunit 6
  ENSP ID: ENSP00000481920
MAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLHYIILSIKINSC

SEQ ID NO: 49849 - protein, 233 aa, Homo sapiens
  Payload ID: 9963
  Gene Symbol: MED7
  Gene Name: mediator complex subunit 7
  Uniprot ID: O43513
  ENSP ID: ENSP00000286317
MGEPQQVSALPPPPMQYIKEYTDENIQEGLAPKPPPPIKDSYMMFGNQFQCDDLIIRPLESQGIERLHPMQFDHKKELRKLNMSILINFLDLLDILIRSPGSIKREEKLEDLKLLFVHVHHLINEYRPHQARETLRVMMEVQKRQRLETAERFQKHLERVIEMIQNCLASLPDDLPHSEAGMRVKTEPMDADDSNNCTGQNEHQRENSGHRRDQIIEKDAALCVLIDEMNERP

SEQ ID NO: 49850 - protein, 233 aa, Homo sapiens; identical to SEQ ID NO: 49849
  Payload ID: 9963
  Gene Symbol: MED7
  Gene Name: mediator complex subunit 7
  Uniprot ID: O43513
  ENSP ID: ENSP00000401046

SEQ ID NO: 49851 - protein, 195 aa, Homo sapiens
  Payload ID: 9963
  Gene Symbol: MED7
  Gene Name: mediator complex subunit 7
  ENSP ID: ENSP00000430746
MGEPQQVSALPPPPMQYIKEYTDENIQEGLAPKPPPPIKDSYMMFGNQFQCDDLIIRPLESQGIERLHPMQFDHKKELRKLNMSILINFLDLLDILIRSPGSIKREEKLEDLKLLFVHVHHLINEYRPHQARETLRVMMEVQKRQRLETAERFQKHLERVIEMIQNCLASLPDDLPHSEAGMRVKTEPMDADDSN

SEQ ID NO: 49852 - protein, 301 aa, Homo sapiens
  Payload ID: 9964
  Gene Symbol: MED8
  Gene Name: mediator complex subunit 8
  Uniprot ID: Q96G25
  ENSP ID: ENSP00000290663
MQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQRPSCLGFILAIPLRRKVKKLLGQEGKKNAHLQLW

SEQ ID NO: 49853 - protein, 179 aa, Homo sapiens
  Payload ID: 9964
  Gene Symbol: MED8
  Gene Name: mediator complex subunit 8
  Uniprot ID: Q96G25
  ENSP ID: ENSP00000361533
MRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQR

SEQ ID NO: 49854 - protein, 268 aa, Homo sapiens
  Payload ID: 9964
  Gene Symbol: MED8
  Gene Name: mediator complex subunit 8
  Uniprot ID: Q96G25
  ENSP ID: ENSP00000361535
MQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQR

SEQ ID NO: 49855 - protein, 146 aa, Homo sapiens
  Payload ID: 9965
  Gene Symbol: MED9
  Gene Name: mediator complex subunit 9
  Uniprot ID: Q9NWA0
  ENSP ID: ENSP00000268711
MASAGVAAGRQAEDVLPPTSDQPLPDTKPLPPPQPPPVPAPQPQQSPAPRPQSPARAREEENYSFLPLVHNIIKCMDKDSPEVHQDLNALKSKFQEMRKLISTMPGIHLSPEQQQQQLQSLREQVRTKNELLQKYKSLCMFEIPKE

SEQ ID NO: 49856 - protein, 82 aa, Homo sapiens
  Payload ID: 9965
  Gene Symbol: MED9
  Gene Name: mediator complex subunit 9
  ENSP ID: ENSP00000462204
MASAGVAAGRQAEDVLPPTSDQPLPDTKPLPPPQPPPVPAPQPQQSPAPRPQSPARAREEENYSFLPLVHNIIKCRDGAGLK

SEQ ID NO: 49857 - protein, 82 aa, Homo sapiens; identical to SEQ ID NO: 49856
  Payload ID: 9965
  Gene Symbol: MED9
  Gene Name: mediator complex subunit 9
  ENSP ID: ENSP00000463031

SEQ ID NO: 49858 - protein, 297 aa, Homo sapiens
  Payload ID: 9966
  Gene Symbol: MEMO1
  Gene Name: mediator of cell motility 1
  Uniprot ID: Q9Y316
  ENSP ID: ENSP00000295065
MSNRVVCREASHAGSWYTASGPQLNAQLEGWLSQVQSTKRPARAIIAPHAGYTYCGSCAAHAYKQVDPSITRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 49859 - protein, 300 aa, Homo sapiens
  Payload ID: 9966
  Gene Symbol: MEMO1
  Gene Name: mediator of cell motility 1
  Uniprot ID: Q9Y316
  ENSP ID: ENSP00000368691
MPLWRADKCQDVQSASWRPRRADGPQLNAQLEGWLSQVQSTKRPARAIIAPHAGYTYCGSCAAHAYKQVDPSITRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 49860 - protein, 100 aa, Homo sapiens
  Payload ID: 9966
  Gene Symbol: MEMO1
  Gene Name: mediator of cell motility 1
  ENSP ID: ENSP00000385321
MSNRVVCREASHAGSWYTASGPQLNAQLEGWLSQVQSTKRPARAIIAPHAGYTYCGSCAAHAYKQVDPSITFSRSALMLNILSLCLFIFSSIRKMPFLII

SEQ ID NO: 49861 - protein, 297 aa, Homo sapiens; identical to SEQ ID NO: 49858
  Payload ID: 9966
  Gene Symbol: MEMO1
  Gene Name: mediator of cell motility 1
  Uniprot ID: Q9Y316
  ENSP ID: ENSP00000385557

SEQ ID NO: 49862 - protein, 274 aa, Homo sapiens
  Payload ID: 9966
  Gene Symbol: MEMO1
  Gene Name: mediator of cell motility 1
  Uniprot ID: Q9Y316
  ENSP ID: ENSP00000400795
MSNRVVCREASHAGSWYTASGPQLNAQLEGWLSQVQSTKRPARAIIAPRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 49863 - protein, 20 aa, Homo sapiens
  Payload ID: 9966
  Gene Symbol: MEMO1
  Gene Name: mediator of cell motility 1
  ENSP ID: ENSP00000409621
MSNRVVCREASHAGSWYTAS

SEQ ID NO: 49864 - protein, 2089 aa, Homo sapiens
  Payload ID: 9967
  Gene Symbol: MDC1
  Gene Name: mediator of DNA-damage checkpoint 1
  Uniprot ID: Q14676
  ENSP ID: ENSP00000365588
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 49865 - protein, 2089 aa, Homo sapiens
  Payload ID: 9967
  Gene Symbol: MDC1
  Gene Name: mediator of DNA-damage checkpoint 1
  Uniprot ID: Q14676
  ENSP ID: ENSP00000373060
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKEKDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 49866 - protein, 2089 aa, Homo sapiens; identical to SEQ ID NO: 49864
  Payload ID: 9967
  Gene Symbol: MDC1
  Gene Name: mediator of DNA-damage checkpoint 1
  Uniprot ID: Q14676
  ENSP ID: ENSP00000387429

SEQ ID NO: 49867 - protein, 126 aa, Homo sapiens
  Payload ID: 9967
  Gene Symbol: MDC1
  Gene Name: mediator of DNA-damage checkpoint 1
  ENSP ID: ENSP00000387706
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADL

SEQ ID NO: 49868 - protein, 113 aa, Homo sapiens
  Payload ID: 9967
  Gene Symbol: MDC1
  Gene Name: mediator of DNA-damage checkpoint 1
  ENSP ID: ENSP00000387743
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSH

SEQ ID NO: 49869 - protein, 162 aa, Homo sapiens
  Payload ID: 9967
  Gene Symbol: MDC1
  Gene Name: mediator of DNA-damage checkpoint 1
  ENSP ID: ENSP00000388355
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRL

SEQ ID NO: 49870 - protein, 113 aa, Homo sapiens; identical to SEQ ID NO: 49868
  Payload ID: 9967
  Gene Symbol: MDC1
  Gene Name: mediator of DNA-damage checkpoint 1
  ENSP ID: ENSP00000390040

SEQ ID NO: 49871 - protein, 162 aa, Homo sapiens; identical to SEQ ID NO: 49869
  Payload ID: 9967
  Gene Symbol: MDC1
  Gene Name: mediator of DNA-damage checkpoint 1
  ENSP ID: ENSP00000390489

SEQ ID NO: 49872 - protein, 113 aa, Homo sapiens; identical to SEQ ID NO: 49868
  Payload ID: 9967
  Gene Symbol: MDC1
  Gene Name: mediator of DNA-damage checkpoint 1
  ENSP ID: ENSP00000391230

SEQ ID NO: 49873 - protein, 162 aa, Homo sapiens; identical to SEQ ID NO: 49869
  Payload ID: 9967
  Gene Symbol: MDC1
  Gene Name: mediator of DNA-damage checkpoint 1
  ENSP ID: ENSP00000392784

SEQ ID NO: 49874 - protein, 162 aa, Homo sapiens; identical to SEQ ID NO: 49869
  Payload ID: 9967
  Gene Symbol: MDC1
  Gene Name: mediator of DNA-damage checkpoint 1
  ENSP ID: ENSP00000392833

SEQ ID NO: 49875 - protein, 126 aa, Homo sapiens; identical to SEQ ID NO: 49867
  Payload ID: 9967
  Gene Symbol: MDC1
  Gene Name: mediator of DNA-damage checkpoint 1
  ENSP ID: ENSP00000393886

SEQ ID NO: 49876 - protein, 113 aa, Homo sapiens; identical to SEQ ID NO: 49868
  Payload ID: 9967
  Gene Symbol: MDC1
  Gene Name: mediator of DNA-damage checkpoint 1
  ENSP ID: ENSP00000394074

SEQ ID NO: 49877 - protein, 306 aa, Homo sapiens
  Payload ID: 9967
  Gene Symbol: MDC1
  Gene Name: mediator of DNA-damage checkpoint 1
  ENSP ID: ENSP00000396121
  MOD_RES (1)..(1): Any amino acid
XHVGGTKDSEDNYGDSEDLDLQATQCFLENQGLEAVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVP

SEQ ID NO: 49878 - protein, 306 aa, Homo sapiens; identical to SEQ ID NO: 49877
  Payload ID: 9967
  Gene Symbol: MDC1
  Gene Name: mediator of DNA-damage checkpoint 1
  ENSP ID: ENSP00000396124
  MOD_RES (1)..(1): Any amino acid

SEQ ID NO: 49879 - protein, 162 aa, Homo sapiens; identical to SEQ ID NO: 49869
  Payload ID: 9967
  Gene Symbol: MDC1
  Gene Name: mediator of DNA-damage checkpoint 1
  ENSP ID: ENSP00000396389

SEQ ID NO: 49880 - protein, 2089 aa, Homo sapiens; identical to SEQ ID NO: 49864
  Payload ID: 9967
  Gene Symbol: MDC1
  Gene Name: mediator of DNA-damage checkpoint 1
  Uniprot ID: Q14676
  ENSP ID: ENSP00000396484

SEQ ID NO: 49881 - protein, 126 aa, Homo sapiens; identical to SEQ ID NO: 49867
  Payload ID: 9967
  Gene Symbol: MDC1
  Gene Name: mediator of DNA-damage checkpoint 1
  ENSP ID: ENSP00000396989

SEQ ID NO: 49882 - protein, 306 aa, Homo sapiens; identical to SEQ ID NO: 49877
  Payload ID: 9967
  Gene Symbol: MDC1
  Gene Name: mediator of DNA-damage checkpoint 1
  ENSP ID: ENSP00000397021
  MOD_RES (1)..(1): Any amino acid

SEQ ID NO: 49883 - protein, 162 aa, Homo sapiens; identical to SEQ ID NO: 49869
  Payload ID: 9967
  Gene Symbol: MDC1
  Gene Name: mediator of DNA-damage checkpoint 1
  ENSP ID: ENSP00000397126

SEQ ID NO: 49884 - protein, 306 aa, Homo sapiens; identical to SEQ ID NO: 49877
  Payload ID: 9967
  Gene Symbol: MDC1
  Gene Name: mediator of DNA-damage checkpoint 1
  ENSP ID: ENSP00000397642
  MOD_RES (1)..(1): Any amino acid

SEQ ID NO: 49885 - protein, 126 aa, Homo sapiens; identical to SEQ ID NO: 49867
  Payload ID: 9967
  Gene Symbol: MDC1
  Gene Name: mediator of DNA-damage checkpoint 1
  ENSP ID: ENSP00000398151

SEQ ID NO: 49886 - protein, 306 aa, Homo sapiens; identical to SEQ ID NO: 49877
  Payload ID: 9967
  Gene Symbol: MDC1
  Gene Name: mediator of DNA-damage checkpoint 1
  ENSP ID: ENSP00000398474
  MOD_RES (1)..(1): Any amino acid

SEQ ID NO: 49887 - protein, 126 aa, Homo sapiens; identical to SEQ ID NO: 49867
  Payload ID: 9967
  Gene Symbol: MDC1
  Gene Name: mediator of DNA-damage checkpoint 1
  ENSP ID: ENSP00000400305

SEQ ID NO: 49888 - protein, 162 aa, Homo sapiens; identical to SEQ ID NO: 49869
  Payload ID: 9967
  Gene Symbol: MDC1
  Gene Name: mediator of DNA-damage checkpoint 1
  ENSP ID: ENSP00000400979

SEQ ID NO: 49889 - protein, 2089 aa, Homo sapiens
  Payload ID: 9967
  Gene Symbol: MDC1
  Gene Name: mediator of DNA-damage checkpoint 1
  Uniprot ID: Q14676
  ENSP ID: ENSP00000404318
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPALQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 49890 - protein, 126 aa, Homo sapiens; identical to SEQ ID NO: 49867
  Payload ID: 9967
  Gene Symbol: MDC1
  Gene Name: mediator of DNA-damage checkpoint 1
  ENSP ID: ENSP00000404954

SEQ ID NO: 49891 - protein, 113 aa, Homo sapiens; identical to SEQ ID NO: 49868
  Payload ID: 9967
  Gene Symbol: MDC1
  Gene Name: mediator of DNA-damage checkpoint 1
  ENSP ID: ENSP00000405350

SEQ ID NO: 49892 - protein, 306 aa, Homo sapiens; identical to SEQ ID NO: 49877
  Payload ID: 9967
  Gene Symbol: MDC1
  Gene Name: mediator of DNA-damage checkpoint 1
  ENSP ID: ENSP00000405806
  MOD_RES (1)..(1): Any amino acid

SEQ ID NO: 49893 - protein, 126 aa, Homo sapiens; identical to SEQ ID NO: 49867
  Payload ID: 9967
  Gene Symbol: MDC1
  Gene Name: mediator of DNA-damage checkpoint 1
  ENSP ID: ENSP00000405991

SEQ ID NO: 49894 - protein, 162 aa, Homo sapiens; identical to SEQ ID NO: 49869
  Payload ID: 9967
  Gene Symbol: MDC1
  Gene Name: mediator of DNA-damage checkpoint 1
  ENSP ID: ENSP00000407703

SEQ ID NO: 49895 - protein, 113 aa, Homo sapiens; identical to SEQ ID NO: 49868
  Payload ID: 9967
  Gene Symbol: MDC1
  Gene Name: mediator of DNA-damage checkpoint 1
  ENSP ID: ENSP00000408831

SEQ ID NO: 49896 - protein, 306 aa, Homo sapiens; identical to SEQ ID NO: 49877
  Payload ID: 9967
  Gene Symbol: MDC1
  Gene Name: mediator of DNA-damage checkpoint 1
  ENSP ID: ENSP00000408962
  MOD_RES (1)..(1): Any amino acid

SEQ ID NO: 49897 - protein, 2089 aa, Homo sapiens; identical to SEQ ID NO: 49864
  Payload ID: 9967
  Gene Symbol: MDC1
  Gene Name: mediator of DNA-damage checkpoint 1
  Uniprot ID: Q14676
  ENSP ID: ENSP00000409167

SEQ ID NO: 49898 - protein, 126 aa, Homo sapiens; identical to SEQ ID NO: 49867
  Payload ID: 9967
  Gene Symbol: MDC1
  Gene Name: mediator of DNA-damage checkpoint 1
  ENSP ID: ENSP00000410383

SEQ ID NO: 49899 - protein, 113 aa, Homo sapiens; identical to SEQ ID NO: 49868
  Payload ID: 9967
  Gene Symbol: MDC1
  Gene Name: mediator of DNA-damage checkpoint 1
  ENSP ID: ENSP00000411310

SEQ ID NO: 49900 - protein, 306 aa, Homo sapiens; identical to SEQ ID NO: 49877
  Payload ID: 9967
  Gene Symbol: MDC1
  Gene Name: mediator of DNA-damage checkpoint 1
  ENSP ID: ENSP00000413610
  MOD_RES (1)..(1): Any amino acid

SEQ ID NO: 49901 - protein, 113 aa, Homo sapiens; identical to SEQ ID NO: 49868
  Payload ID: 9967
  Gene Symbol: MDC1
  Gene Name: mediator of DNA-damage checkpoint 1
  ENSP ID: ENSP00000414163

SEQ ID NO: 49902 - protein, 2089 aa, Homo sapiens; identical to SEQ ID NO: 49864
  Payload ID: 9967
  Gene Symbol: MDC1
  Gene Name: mediator of DNA-damage checkpoint 1
  Uniprot ID: Q14676
  ENSP ID: ENSP00000415212

SEQ ID NO: 49903 - protein, 2089 aa, Homo sapiens; identical to SEQ ID NO: 49864
  Payload ID: 9967
  Gene Symbol: MDC1
  Gene Name: mediator of DNA-damage checkpoint 1
  Uniprot ID: Q14676
  ENSP ID: ENSP00000416511

SEQ ID NO: 49904 - protein, 142 aa, Homo sapiens
  Payload ID: 9967
  Gene Symbol: MDC1
  Gene Name: mediator of DNA-damage checkpoint 1
  ENSP ID: ENSP00000447771
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNVPSPGCLSALCLPGPSDSRRDTQSTGRNSTPEASVGGLGGGSRFSF

SEQ ID NO: 49905 - protein, 142 aa, Homo sapiens; identical to SEQ ID NO: 49904
  Payload ID: 9967
  Gene Symbol: MDC1
  Gene Name: mediator of DNA-damage checkpoint 1
  ENSP ID: ENSP00000447851

SEQ ID NO: 49906 - protein, 142 aa, Homo sapiens; identical to SEQ ID NO: 49904
  Payload ID: 9967
  Gene Symbol: MDC1
  Gene Name: mediator of DNA-damage checkpoint 1
  ENSP ID: ENSP00000447883

SEQ ID NO: 49907 - protein, 142 aa, Homo sapiens; identical to SEQ ID NO: 49904
  Payload ID: 9967
  Gene Symbol: MDC1
  Gene Name: mediator of DNA-damage checkpoint 1
  ENSP ID: ENSP00000448066

SEQ ID NO: 49908 - protein, 142 aa, Homo sapiens; identical to SEQ ID NO: 49904
  Payload ID: 9967
  Gene Symbol: MDC1
  Gene Name: mediator of DNA-damage checkpoint 1
  ENSP ID: ENSP00000448232

SEQ ID NO: 49909 - protein, 142 aa, Homo sapiens; identical to SEQ ID NO: 49904
  Payload ID: 9967
  Gene Symbol: MDC1
  Gene Name: mediator of DNA-damage checkpoint 1
  ENSP ID: ENSP00000449936

SEQ ID NO: 49910 - protein, 142 aa, Homo sapiens; identical to SEQ ID NO: 49904
  Payload ID: 9967
  Gene Symbol: MDC1
  Gene Name: mediator of DNA-damage checkpoint 1
  ENSP ID: ENSP00000450002

SEQ ID NO: 49911 - protein, 142 aa, Homo sapiens; identical to SEQ ID NO: 49904
  Payload ID: 9967
  Gene Symbol: MDC1
  Gene Name: mediator of DNA-damage checkpoint 1
  ENSP ID: ENSP00000483601

SEQ ID NO: 49912 - protein, 781 aa, Homo sapiens
  Payload ID: 9968
  Gene Symbol: MEFV
  Gene Name: Mediterranean fever
  Uniprot ID: O15553
  ENSP ID: ENSP00000219596
MAKTPSDHLLSTLEELVPYDFEKFKFKLQNTSVQKEHSRIPRSQIQRARPVKMATLLVTYYGEEYAVQLTLQVLRAINQRLLAEELHRAAIQEYSTQENGTDDSAASSSLGENKPRSLKTPDHPEGNEGNGPRPYGGGAASLRCSQPEAGRGLSRKPLSKRREKASEGLDAQGKPRTRSPALPGGRSPGPCRALEGGQAEVRLRRNASSAGRLQGLAGGAPGQKECRPFEVYLPSGKMRPRSLEVTISTGEKAPANPEILLTLEEKTAANLDSATEPRARPTPDGGASADLKEGPGNPEHSVTGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNVPELIGAQAHAVNVILDAETAYPNLIFSDDLKSVRLGNKWERLPDGPQRFDSCIIVLGSPSFLSGRRYWEVEVGDKTAWILGACKTSISRKGNMTLSPENGYWVVIMMKENEYQASSVPPTRLLIKEPPKRVGIFVDYRVGSISFYNVTARSHIYTFASCSFSGPLQPIFSPGTRDGGKNTAPLTICPVGGQGPD

SEQ ID NO: 49913 - protein, 601 aa, Homo sapiens
  Payload ID: 9968
  Gene Symbol: MEFV
  Gene Name: Mediterranean fever
  ENSP ID: ENSP00000339639
MAKTPSDHLLSTLEELVPYDFEKFKFKLQNTSVQKEHSRIPRSQIQRARPVKMATLLVTYYGEEYAVQLTLQVLRAINQRLLAEELHRAAIQDMGSCYVAQVGLELLISNNPPIFASETAGITGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNVPELIGAQAHAVNVILDAETAYPNLIFSDDLKSVRLGNKWERLPDGPQRFDSCIIVLGSPSFLSGRRYWEVEVGDKTAWILGACKTSISRKGNMTLSPENGYWVVIMMKENEYQASSVPPTRLLIKEPPKRVGIFVDYRVGSISFYNVTARSHIYTFASCSFSGPLQPIFSPGTRDGGKNTAPLTICPVGGQGPD

SEQ ID NO: 49914 - protein, 490 aa, Homo sapiens
  Payload ID: 9968
  Gene Symbol: MEFV
  Gene Name: Mediterranean fever
  ENSP ID: ENSP00000437486
MAKTPSDHLLSTLEELVPYDFEKFKFKLQNTSVQKEHSRIPRSQIQRARPVKMATLLVTYYGEEYAVQLTLQVLRAINQRLLAEELHRAAIQEYSTQENGTDDSAASSSLGENKPRSLKTPDHPEGNEGNGPRPYGGGAASLRCSQPEAGRGLSRKPLSKRREKASEGLDAQGKPRTRSPALPGGRSPGPCRALEGGQAEVRLRRNASSAGRLQGLAGGAPGQKECRPFEVYLPSGKMRPRSLEVTISTGEKAPANPEILLTLEEKTAANLDSATEPRARPTPDGGASADLKEGPGNPEHSVTGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLVVVQWCDLGSLQPLPPGFKRFSCLSLLSSWDYRNKLKR

SEQ ID NO: 49915 - protein, 613 aa, Homo sapiens
  Payload ID: 9968
  Gene Symbol: MEFV
  Gene Name: Mediterranean fever
  ENSP ID: ENSP00000438611
MAKTPSDHLLSTLEELVPYDFEKFKFKLQNTSVQKEHSRIPRSQIQRARPVKMATLLVTYYGEEYAVQLTLQVLRAINQRLLAEELHRAAIQEYSTQENGTDDSAASSSLGENKPRSLKTPDHPEGNEGNGPRPYGGGAASLRCSQPEAGRGLSRKPLSKRREKASEGLDAQGKPRTRSPALPGGRSPGPCRALEGGQAEVRLRRNASSAGRLQGLAGGAPGQKECRPFEVYLPSGKMRPRSLEVTISTGEKAPANPEILLTLEEKTAANLDSATEPRARPTPDGGASADLKEGPGNPEHSVTGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNGESSGNGVCWPGVVAVFPCAVDLRGPI

SEQ ID NO: 49916 - protein, 445 aa, Homo sapiens
  Payload ID: 9968
  Gene Symbol: MEFV
  Gene Name: Mediterranean fever
  Uniprot ID: O15553
  ENSP ID: ENSP00000438711
MAKTPSDHLLSTLEELVPYDFEKFKFKLQNTSVQKEHSRIPRSQIQRARPVKMATLLVTYYGEEYAVQLTLQVLRAINQRLLAEELHRAAIQGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNDHSPQHGLGSWEERDYTQHSMQGPKQGVPCLSLLSGQCNLAPLNANAQDFFPYLIFLRSSGADWRSGTCC

SEQ ID NO: 49917 - protein, 402 aa, Homo sapiens
  Payload ID: 9968
  Gene Symbol: MEFV
  Gene Name: Mediterranean fever
  ENSP ID: ENSP00000444178
MAKTPSDHLLSTLEELVPYDFEKFKFKLQNTSVQKEHSRIPRSQIQRARPVKMATLLVTYYGEEYAVQLTLQVLRAINQRLLAEELHRAAIQGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNGESSGNGVCWPGVVAVFPCAVDLRGPI

SEQ ID NO: 49918 - protein, 95 aa, Homo sapiens
  Payload ID: 9968
  Gene Symbol: MEFV
  Gene Name: Mediterranean fever
  ENSP ID: ENSP00000444471
MAKTPSDHLLSTLEELVPYDFEKFKFKLQNTSVQKEHSRIPRSQIQRARPVKMATLLVTYYGEEYAVQLTLQVLRAINQRLLAEELHRAAIQETN

SEQ ID NO: 49919 - protein, 644 aa, Homo sapiens
  Payload ID: 9968
  Gene Symbol: MEFV
  Gene Name: Mediterranean fever
  ENSP ID: ENSP00000444615
MAKTPSDHLLSTLEELVPYDFEKFKFKLQNTSVQKEHSRIPRSQIQRARPVKMATLLVTYYGEEYAVQLTLQVLRAINQRLLAEELHRAAIQEYSTQENGTDDSAASSSLGENKPRSLKTPDHPEGNEGNGPRPYGGGAASLRCSQPEAGRGLSRKPLSKRREKASEGLDAQGKPRTRSPALPGGRSPGPCRALEGGQAEVRLRRNASSAGRLQGLAGGAPGQKECRPFEVYLPSGKMRPRSLEVTISTGEKAPANPEILLTLEEKTAANLDSATEPRARPTPDGGASADLKEGPGNPEHSVTDMGSCYVAQVGLELLISNNPPIFASETAGITGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNGESSGNGVCWPGVVAVFPCAVDLRGPI

SEQ ID NO: 49920 - protein, 570 aa, Homo sapiens
  Payload ID: 9968
  Gene Symbol: MEFV
  Gene Name: Mediterranean fever
  Uniprot ID: O15553
  ENSP ID: ENSP00000445079
MAKTPSDHLLSTLEELVPYDFEKFKFKLQNTSVQKEHSRIPRSQIQRARPVKMATLLVTYYGEEYAVQLTLQVLRAINQRLLAEELHRAAIQGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNVPELIGAQAHAVNVILDAETAYPNLIFSDDLKSVRLGNKWERLPDGPQRFDSCIIVLGSPSFLSGRRYWEVEVGDKTAWILGACKTSISRKGNMTLSPENGYWVVIMMKENEYQASSVPPTRLLIKEPPKRVGIFVDYRVGSISFYNVTARSHIYTFASCSFSGPLQPIFSPGTRDGGKNTAPLTICPVGGQGPD

SEQ ID NO: 49921 - protein, 306 aa, Homo sapiens
  Payload ID: 9968
  Gene Symbol: MEFV
  Gene Name: Mediterranean fever
  ENSP ID: ENSP00000458312
MAKTPSDHLLSTLEELVPYDFEKFKFKLQNTSVQKEHSRIPRSQIQRARPVKMATLLVTYYGEEYAVQLTLQVLRAINQRLLAEELHRAAIQEYSTQENGTDDSAASSSLGENKPRSLKTPDHPEGNEGNGPRPYGGGAASLRCSQPEAGRGLSRKPLSKRREKASEGLDAQGKPRTRSPALPGGRSPGPCRALEGGQAEVRLRRNASSAGRLQGLAGGAPGQKECRPFEVYLPSGKMRPRSLEVTISTGEKAPANPEILLTLEEKTAANLDSATEPRARPTPDGGASADLKEGPGNPEHSVTETN

SEQ ID NO: 49922 - protein, 95 aa, Homo sapiens; identical to SEQ ID NO: 49918
  Payload ID: 9968
  Gene Symbol: MEFV
  Gene Name: Mediterranean fever
  ENSP ID: ENSP00000460269

SEQ ID NO: 49923 - protein, 95 aa, Homo sapiens; identical to SEQ ID NO: 49918
  Payload ID: 9968
  Gene Symbol: MEFV
  Gene Name: Mediterranean fever
  ENSP ID: ENSP00000460551

SEQ ID NO: 49924 - protein, 101 aa, Homo sapiens
  Payload ID: 9968
  Gene Symbol: MEFV
  Gene Name: Mediterranean fever
  ENSP ID: ENSP00000461186
MAKTPSDHLLSTLEELVPYDFEKFKFKLQNTSVQKEHSRIPRSQIQRARPVKMATLLVTYYGEEYAVQLTLQVLRAINQRLLAEELHRAAIQGHWRHLAQG

SEQ ID NO: 49925 - protein, 411 aa, Homo sapiens
  Payload ID: 9968
  Gene Symbol: MEFV
  Gene Name: Mediterranean fever
  ENSP ID: ENSP00000481436
MAKTPSDHLLSTLEELVPYDFEKFKFKLQNTSVQKEHSRIPRSQIQRARPVKMATLLVTYYGEEYAVQLTLQVLRAINQRLLAEELHRAAIQGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNDHSPQHGLGSWEERDYTQHSMQGPKQGVPCLVVRTV

SEQ ID NO: 49926 - protein, 415 aa, Homo sapiens
  Payload ID: 9969
  Gene Symbol: MAMSTR
  Gene Name: MEF2 activating motif and SAP domain containing transcriptional regulator
  Uniprot ID: Q6ZN01
  ENSP ID: ENSP00000324175
MTLAASSQRSQIIRSKFRSVLQLRIHRRNQEQISDPDPWISASDPPLAPALPSGTAPFLFSPGVLLPEPEYCPPWRSPKKESPKISQRWRESKPRGNLTYHQYMPPEPRQGSRADPQAEGSALGPPGPSLWEGTDSQQPHPRMKPSPLTPCPPGVPSPSPPPHKLELQTLKLEELTVSELRQQLRLRGLPVSGTKSMLLERMRGGAPPRERPKPRREDSPAGAPWPRLKPKALAAARRQGSVKPSAASHRPPLPRAADTPGTAPAPTPTPAPAAAPALTPSSGPGSAALTLEEELQEAIRRAQLLPNRGIDDILEDQVEPDDPLPPIPLDFPGSFDVLSPSPDSEGLSSVFSSSLPSPTNSSSPSPRDPTDSLDWLEALSGGPPLGSGPPPPSIFSADLSDSSSSRLWDLLEDPW

SEQ ID NO: 49927 - protein, 312 aa, Homo sapiens
  Payload ID: 9969
  Gene Symbol: MAMSTR
  Gene Name: MEF2 activating motif and SAP domain containing transcriptional regulator
  Uniprot ID: Q6ZN01
  ENSP ID: ENSP00000349192
MPPEPRQGSRADPQAEGSALGPPGPSLWEGTDSQQPHPRMKPSPLTPCPPGVPSPSPPPHKLELQTLKLEELTVSELRQQLRLRGLPVSGTKSMLLERMRGGAPPRERPKPRREDSPAGAPWPRLKPKALAAARRQGSVKPSAASHRPPLPRAADTPGTAPAPTPTPAPAAAPALTPSSGPGSAALTLEEELQEAIRRAQLLPNRGIDDILEDQVEPDDPLPPIPLDFPGSFDVLSPSPDSEGLSSVFSSSLPSPTNSSSPSPRDPTDSLDWLEALSGGPPLGSGPPPPSIFSADLSDSSSSRLWDLLEDPW

SEQ ID NO: 49928 - protein, 11 aa, Homo sapiens
  Payload ID: 9969
  Gene Symbol: MAMSTR
  Gene Name: MEF2 activating motif and SAP domain containing transcriptional regulator
  ENSP ID: ENSP00000469127
MPPEPRQGSRA

SEQ ID NO: 49929 - protein, 219 aa, Homo sapiens
  Payload ID: 9969
  Gene Symbol: MAMSTR
  Gene Name: MEF2 activating motif and SAP domain containing transcriptional regulator
  ENSP ID: ENSP00000469544
MTLAASSQRSQIIRSKFRSVLQLRIHRRNQEQNPVQAPISQQSSLAPWPALRHPGAPLSTQPCSSRPGLLPAGLSGSFTVSPVSDPDPWISASDPPLAPALPSGTAPFLFSPGVLLPEPEYCPPWRSPKKESPKISQRWRESKPRGNLTYHQYMPPEPRQGSRADPQAEGSALGPPGPSLWEGTDSQQPHPRMKPSPLTPCPPGVPSPSPPPHKLELQT

SEQ ID NO: 49930 - protein, 247 aa, Homo sapiens
  Payload ID: 9969
  Gene Symbol: MAMSTR
  Gene Name: MEF2 activating motif and SAP domain containing transcriptional regulator
  Uniprot ID: Q6ZN01
  ENSP ID: ENSP00000471590
MPPEPRQGSRADPQAEGSALGPPGPSLWEGTDSQQPHPRMKPSPLTPCPPGVPSPSPPPHKLELQTLKLEELTVKPSAASHRPPLPRAADTPGTAPAPTPTPAPAAAPALTPSSGPGSAALTLEEELQEAIRRAQLLPNRGIDDILEDQVEPDDPLPPIPLDFPGSFDVLSPSPDSEGLSSVFSSSLPSPTNSSSPSPRDPTDSLDWLEALSGGPPLGSGPPPPSIFSADLSDSSSSRLWDLLEDPW

SEQ ID NO: 49931 - protein, 931 aa, Homo sapiens
  Payload ID: 9970
  Gene Symbol: MKL1
  Gene Name: megakaryoblastic leukemia (translocation) 1
  Uniprot ID: Q969V6
  ENSP ID: ENSP00000347847
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 49932 - protein, 798 aa, Homo sapiens
  Payload ID: 9970
  Gene Symbol: MKL1
  Gene Name: megakaryoblastic leukemia (translocation) 1
  ENSP ID: ENSP00000379861
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGGNPRNFSRFQGAAIPAREGEAIPEDSLWVPPGSTAITFC

SEQ ID NO: 49933 - protein, 161 aa, Homo sapiens
  Payload ID: 9970
  Gene Symbol: MKL1
  Gene Name: megakaryoblastic leukemia (translocation) 1
  ENSP ID: ENSP00000385076
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIGEEDPATLCERQLRCRRGGSARLKQNWAEALDFLIFDFLLSLGRTKAQSLRASCTGCMNLG

SEQ ID NO: 49934 - protein, 881 aa, Homo sapiens
  Payload ID: 9970
  Gene Symbol: MKL1
  Gene Name: megakaryoblastic leukemia (translocation) 1
  ENSP ID: ENSP00000385584
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 49935 - protein, 931 aa, Homo sapiens; identical to SEQ ID NO: 49931
  Payload ID: 9970
  Gene Symbol: MKL1
  Gene Name: megakaryoblastic leukemia (translocation) 1
  Uniprot ID: Q969V6
  ENSP ID: ENSP00000385835

SEQ ID NO: 49936 - protein, 73 aa, Homo sapiens
  Payload ID: 9970
  Gene Symbol: MKL1
  Gene Name: megakaryoblastic leukemia (translocation) 1
  ENSP ID: ENSP00000398478
MRREGSTVLQLKLQQRRTREELVSQGIMPPLKSPAAFHEQRRSLERARTEDYLKRKIRSRPERSELVRMHILE

SEQ ID NO: 49937 - protein, 882 aa, Homo sapiens
  Payload ID: 9970
  Gene Symbol: MKL1
  Gene Name: megakaryoblastic leukemia (translocation) 1
  ENSP ID: ENSP00000478420
MIPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 49938 - protein, 966 aa, Homo sapiens
  Payload ID: 9970
  Gene Symbol: MKL1
  Gene Name: megakaryoblastic leukemia (translocation) 1
  ENSP ID: ENSP00000479510
MTLLEPEMLMMAVQSVLQLKLQQRRTREELVSQGIMPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 49939 - protein, 85 aa, Homo sapiens
  Payload ID: 9970
  Gene Symbol: MKL1
  Gene Name: megakaryoblastic leukemia (translocation) 1
  ENSP ID: ENSP00000484628
MLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 49940 - protein, 799 aa, Homo sapiens
  Payload ID: 9970
  Gene Symbol: MKL1
  Gene Name: megakaryoblastic leukemia (translocation) 1
  ENSP ID: ENSP00000484786
MIPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGGNPRNFSRFQGAAIPAREGEAIPEDSLWVPPGSTAITFC

SEQ ID NO: 49941 - protein, 507 aa, Homo sapiens
  Payload ID: 9971
  Gene Symbol: MATK
  Gene Name: megakaryocyte-associated tyrosine kinase
  Uniprot ID: P42679
  ENSP ID: ENSP00000308734
MAGRGSLVSWRAFHGCDSAEELPRVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 49942 - protein, 466 aa, Homo sapiens
  Payload ID: 9971
  Gene Symbol: MATK
  Gene Name: megakaryocyte-associated tyrosine kinase
  Uniprot ID: P42679
  ENSP ID: ENSP00000378481
MPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 49943 - protein, 508 aa, Homo sapiens
  Payload ID: 9971
  Gene Symbol: MATK
  Gene Name: megakaryocyte-associated tyrosine kinase
  Uniprot ID: P42679
  ENSP ID: ENSP00000378485
MQGHFPAERREGRPRRGTRGQQQLLVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 49944 - protein, 13 aa, Homo sapiens
  Payload ID: 9971
  Gene Symbol: MATK
  Gene Name: megakaryocyte-associated tyrosine kinase
  ENSP ID: ENSP00000465556
MAGRGSLVSWRAF

SEQ ID NO: 49945 - protein, 237 aa, Homo sapiens
  Payload ID: 9971
  Gene Symbol: MATK
  Gene Name: megakaryocyte-associated tyrosine kinase
  ENSP ID: ENSP00000465761
VSFGRDVIHYRVLHRDGHLTIDEAVFFCNLMDMVERPPGNGTGCWGSPPWGWAHGCPTILQHYSKDKGAICTKLVRPKRKHGTKSAEEELARGPQLRHSSVTIIHHLSQKPGPEPPPTPSSSIPSLARFPRPAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLL

SEQ ID NO: 49946 - protein, 174 aa, Homo sapiens
  Payload ID: 9971
  Gene Symbol: MATK
  Gene Name: megakaryocyte-associated tyrosine kinase
  ENSP ID: ENSP00000467006
MAGRGSLVSWRAFHGCDSAEELPRVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHR

SEQ ID NO: 49947 - protein, 38 aa, Homo sapiens
  Payload ID: 9971
  Gene Symbol: MATK
  Gene Name: megakaryocyte-associated tyrosine kinase
  ENSP ID: ENSP00000467472
MQGHFPAERREGRPRRGTRGQQQLLKTGRTRLGPVAPS

SEQ ID NO: 49948 - protein, 84 aa, Homo sapiens
  Payload ID: 9971
  Gene Symbol: MATK
  Gene Name: megakaryocyte-associated tyrosine kinase
  ENSP ID: ENSP00000467992
MPTRRWAPGTQCITKCEHTRPKPGELAFRKGDVVTILEACENKSWYRVKHHTSGQEGLLAAGALREREALSADPKLSLMPWFHG

SEQ ID NO: 49949 - protein, 506 aa, Homo sapiens
  Payload ID: 9971
  Gene Symbol: MATK
  Gene Name: megakaryocyte-associated tyrosine kinase
  ENSP ID: ENSP00000468030
MAGRGSLVSWRAFHGCDSAEELPRVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 49950 - protein, 131 aa, Homo sapiens
  Payload ID: 9971
  Gene Symbol: MATK
  Gene Name: megakaryocyte-associated tyrosine kinase
  ENSP ID: ENSP00000468465
MPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVL

SEQ ID NO: 49951 - protein, 267 aa, Homo sapiens
  Payload ID: 9971
  Gene Symbol: MATK
  Gene Name: megakaryocyte-associated tyrosine kinase
  ENSP ID: ENSP00000468576
SADPKLSLMPWFHGKISGQEAVQQLQPPEDGLFLVRESARHPGDYVLCVSFGRDVIHYRVLHRDGHLTIDEAVFFCNLMDMVERPPGNGTGCWGSPPWGWAHGCPTILQHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRD

SEQ ID NO: 49952 - protein, 527 aa, Homo sapiens
  Payload ID: 9971
  Gene Symbol: MATK
  Gene Name: megakaryocyte-associated tyrosine kinase
  ENSP ID: ENSP00000478847
MAGRGSLVSWRAFHGCDSAEELPRVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGFTSKSDVWSFGVLLWEVFSYGRAPYPKMSLKEVSEAVEKGYRMEPPEGCPGPVHVLMSSCWEAEPPAGHPSANWPRSWPGSYAVQVPQPPSQGRTPTLHLAPKPGALTPPGGPWPQRTERVESAAWGH

SEQ ID NO: 49953 - protein, 508 aa, Homo sapiens; identical to SEQ ID NO: 49943
  Payload ID: 9971
  Gene Symbol: MATK
  Gene Name: megakaryocyte-associated tyrosine kinase
  Uniprot ID: P42679
  ENSP ID: ENSP00000483213

SEQ ID NO: 49954 - protein, 377 aa, Homo sapiens
  Payload ID: 9972
  Gene Symbol: MLC1
  Gene Name: megalencephalic leukoencephalopathy with subcortical cysts 1
  Uniprot ID: Q15049
  ENSP ID: ENSP00000310375
MTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 49955 - protein, 377 aa, Homo sapiens; identical to SEQ ID NO: 49954
  Payload ID: 9972
  Gene Symbol: MLC1
  Gene Name: megalencephalic leukoencephalopathy with subcortical cysts 1
  Uniprot ID: Q15049
  ENSP ID: ENSP00000379216

SEQ ID NO: 49956 - protein, 223 aa, Homo sapiens
  Payload ID: 9972
  Gene Symbol: MLC1
  Gene Name: megalencephalic leukoencephalopathy with subcortical cysts 1
  ENSP ID: ENSP00000401385
MTQEPFREELAYDRMPTLERGRQDPASYAPDAKPSDLQLSKRLPPCFSHKTWVFSVLMGCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECP

SEQ ID NO: 49957 - protein, 530 aa, Homo sapiens
  Payload ID: 9973
  Gene Symbol: M1AP
  Gene Name: meiosis 1 associated protein
  Uniprot ID: Q8TC57
  ENSP ID: ENSP00000290536
MHPGRTTGKGPSTHTQIDQQPPRLLIVHIALPSWADICTNLCEALQNFFSLACSLMGPSRMSLFSLYMVQDQHECILPFVQVKGNFARLQTCISELRMLQREGCFRSQGASLRLAVEDGLQQFKQYSRHVTTRAALTYTSLEITILTSQPGKEVVKQLEEGLKDTDLARVRRFQVVEVTKGILEHVDSASPVEDTSNDESSILGTDIDLQTIDNDIVSMEIFFKAWLHNSGTDQEQIHLLLSSQCFSNISRPRDNPMCLKCDLQERLLCPSLLAGTADGSLRMDDPKGDFITLYQMASQSSASHYKLQVIKALKSSGLCESLTYGLPFILRPTSCWQLDWDELETNQQHFHALCHSLLKREWLLLAKGEPPGPGHSQRIPASTFYVIMPSHSLTLLVKAVATRELMLPSTFPLLPEDPHDDSLKNVESMLDSLELEPTYNPLHVQSHLYSHLSSIYAKPQGRLHPHWESRAPRKHPCKTGQLQTNRARATVAPLPMTPVPGRASKMPAASKSSSDAFFLPSEWEKDPSRP

SEQ ID NO: 49958 - protein, 526 aa, Homo sapiens
  Payload ID: 9973
  Gene Symbol: M1AP
  Gene Name: meiosis 1 associated protein
  Uniprot ID: Q8TC57
  ENSP ID: ENSP00000386793
MHPGRTTGKGPSTHTQIDQQPPRLLIVHIALPSWADICTNLCEALQNFFSLACSLMGPSRMSLFSLYMVQDQHECILPFVQVKGNFARLQTCISELRMLQREGCFRSQGASLRLAVEDGLQQFKQYSRHVTTRAALTYTSLEITILTSQPGKEVVKQLEEGLKDTDLARVRRFQVVEVTKGILEHVDSASPVEDTSNDESSILGTDIDLQTIDNDIVSMEIFFKAWLHNSGTDQEQIHLLLSSQCFSNISRPRDNPMCLKCDLQERLLCPSLLAGTADGSLRMDDPKGDFITLYQMASQSSASHYKLQVIKALKSSGLCESLTYGLPFILRPTSCWQLDWDELETNQQHFHALCHSLLKREWLLLAKGEPPGPGHSQRIPASTFYVIMPSHSLTLLVKAVATRELMLPSTFPLLPEDPHDDSLKNVESMLDSLELEPTYNPLHVQSHLYSHLSSIYAKPQGRLHPHWESRAPRKTGQLQTNRARATVAPLPMTPVPGRASKMPAASKSSSDAFFLPSEWEKDPSRP

SEQ ID NO: 49959 - protein, 155 aa, Homo sapiens
  Payload ID: 9973
  Gene Symbol: M1AP
  Gene Name: meiosis 1 associated protein
  ENSP ID: ENSP00000406107
MHPGRTTGKGPSTHTQIDQQPPRLLIVHIALPSWADICTNLCEALQNFFSLACSLMGPSRMSLFSLYMVQDQHECILPFVQVKGNFARLQTCISELRMLQREGCFRSQGASLRLAVEDGLQQFKQYSRHVTTRAALTYTSLERVLFWELTLTFRL

SEQ ID NO: 49960 - protein, 93 aa, Homo sapiens
  Payload ID: 9973
  Gene Symbol: M1AP
  Gene Name: meiosis 1 associated protein
  ENSP ID: ENSP00000408713
MHPGRTTGKGPSTHTQIDQQPPRLLIVHIALPSWADICTNLCEALQNFFSLACSLMGPSRMSLFSLYMVQDQHECILPFVRVLFWELTLTFRL

SEQ ID NO: 49961 - protein, 142 aa, Homo sapiens
  Payload ID: 9973
  Gene Symbol: M1AP
  Gene Name: meiosis 1 associated protein
  ENSP ID: ENSP00000414882
MHPGRTTGKGPSTHTQIDQQPPRLLIVHIALPSWADICTNLCEALQNFFSLACSLMGPSRMSLFSLYMVQDQHECILPFVQVKGNFARLQTCISELRMLQREGCFRSQGASLRLAVEDGLQQFKQYSRHVTTRAALTYTSLE

SEQ ID NO: 49962 - protein, 526 aa, Homo sapiens; identical to SEQ ID NO: 49958
  Payload ID: 9973
  Gene Symbol: M1AP
  Gene Name: meiosis 1 associated protein
  Uniprot ID: Q8TC57
  ENSP ID: ENSP00000445662

SEQ ID NO: 49963 - protein, 471 aa, Homo sapiens
  Payload ID: 9974
  Gene Symbol: MEIOB
  Gene Name: meiosis specific with OB domains
  Uniprot ID: Q8N635
  ENSP ID: ENSP00000314484
MANSFAARIFTTLSDLQTNMANLKVIGIVIGKTDVKGFPDRKNIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPDIPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCTVHEFLAMTDEQKTALKWQFLLERSKIYLKFVLSHRARSGLKISVLSCKLADPTEASRNLSGQKHV

SEQ ID NO: 49964 - protein, 442 aa, Homo sapiens
  Payload ID: 9974
  Gene Symbol: MEIOB
  Gene Name: meiosis specific with OB domains
  Uniprot ID: Q8N635
  ENSP ID: ENSP00000380504
MANSFAARIFTTLSDLQTNMANLKVIGIVIGKTDVKGFPDRKNIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPDIPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCTFVLSHRARSGLKISVLSCKLADPTEASRNLSGQKHV

SEQ ID NO: 49965 - protein, 471 aa, Homo sapiens; identical to SEQ ID NO: 49963
  Payload ID: 9974
  Gene Symbol: MEIOB
  Gene Name: meiosis specific with OB domains
  Uniprot ID: Q8N635
  ENSP ID: ENSP00000390778

SEQ ID NO: 49966 - protein, 53 aa, Homo sapiens
  Payload ID: 9974
  Gene Symbol: MEIOB
  Gene Name: meiosis specific with OB domains
  ENSP ID: ENSP00000456880
MTCWDNESILLAQSWMPRETVIFASDVRINFDKFRNCMTATVISKTIITTNPD

SEQ ID NO: 49967 - protein, 264 aa, Homo sapiens
  Payload ID: 9974
  Gene Symbol: MEIOB
  Gene Name: meiosis specific with OB domains
  ENSP ID: ENSP00000457416
MTCWDNESILLAQSWMPRETVIFASDVRINFDKFRNCMTATVISKTIITTNPDIPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCTVHEFLAMTDEQKTALKWQFLLERSKIYLKFVLSHRARSGLKISVLSCKLADPTEASRNLSGQKHV

SEQ ID NO: 49968 - protein, 43 aa, Homo sapiens
  Payload ID: 9974
  Gene Symbol: MEIOB
  Gene Name: meiosis specific with OB domains
  ENSP ID: ENSP00000457427
MANSFAARIFTTLSDLQTNMANLILDQKGTLSASPFGIHQHIL

SEQ ID NO: 49969 - protein, 88 aa, Homo sapiens
  Payload ID: 9975
  Gene Symbol: MEIG1
  Gene Name: meiosis/spermiogenesis associated 1
  Uniprot ID: Q5JSS6
  ENSP ID: ENSP00000367486
MASSDVKPKSVSHAKKWSEEIENLYRFQQAGYRDETEYRQVKQVSMVDRWPETGYVKKLQRRDNTFYYYNKQRECDDKEVHKVKIYAY

SEQ ID NO: 49970 - protein, 88 aa, Homo sapiens; identical to SEQ ID NO: 49969
  Payload ID: 9975
  Gene Symbol: MEIG1
  Gene Name: meiosis/spermiogenesis associated 1
  Uniprot ID: Q5JSS6
  ENSP ID: ENSP00000384334

SEQ ID NO: 49971 - protein, 495 aa, Homo sapiens
  Payload ID: 9976
  Gene Symbol: MNS1
  Gene Name: meiosis-specific nuclear structural 1
  Uniprot ID: Q8NEH6
  ENSP ID: ENSP00000260453
MGSKRRNLSCSERHQKLVDENYCKKLHVQALKNVNSQIRNQMVQNENDNRVQRKQFLRLLQNEQFELDMEEAIQKAEENKRLKELQLKQEEKLAMELAKLKHESLKDEKMRQQVRENSIELRELEKKLKAAYMNKERAAQIAEKDAIKYEQMKRDAEIAKTMMEEHKRIIKEENAAEDKRNKAKAQYYLDLEKQLEEQEKKKQEAYEQLLKEKLMIDEIVRKIYEEDQLEKQQKLEKMNAMRRYIEEFQKEQALWRKKKREEMEEENRKIIEFANMQQQREEDRMAKVQENEEKRLQLQNALTQKLEEMLRQREDLEQVRQELYQEEQAEIYKSKLKEEAEKKLRKQKEMKQDFEEQMALKELVLQAAKEEEENFRKTMLAKFAEDDRIELMNAQKQRMKQLEHRRAVEKLIEERRQQFLADKQRELEEWQLQQRRQGFINAIIEEERLKLLKEHATNLLGYLPKGVFKKEDDIDLLGEEFRKVYQQRSEICEEK

SEQ ID NO: 49972 - protein, 1274 aa, Homo sapiens
  Payload ID: 9977
  Gene Symbol: MEI1
  Gene Name: meiotic double-stranded break formation protein 1
  Uniprot ID: Q5TIA1
  ENSP ID: ENSP00000384115
MAVRQAATAGTPGPRREEEAALLFERAHYRHDPRWLLPVTPRLCLACALELLPDPGVSLVRKKHMLSCFQDALVRHTSLVTQLVSQDQRVCIHFISVLFGLLCSMEDGSVTDLCIEVLIQITTQLKLEQTIRCLLDECHKELCNMPSMRGSLATLTLLGKLVDAIPALADELVMEHGNLMEHLLRGLVYPSEGIQASVCYLYGKLYSSPVAAEMLSGHFREKLFPLFLSILDGAQTKELQINCLGLLRQLLKYDLFVSMIMNQDGLGESAKNIEGSSGNTSLPLVLKKLLLSRDETLQVASAHCITAVLVHSPAKHASAFIHADIPEFLFEHLSSSSEVLVWSSCNCLTLLVEEPLFFSKCHTVYGIEAVVRSLQGSLKMNNIELHKQGLLLFAEILTRQPEEIKLFTSSAMCRDAGRALQEAVSSPVLEVAAEALKATSAFLRKDHQSTPPVQYGELQALLEAMLNRCAEFSQTLLSRRPLGHASSRDSEKAILQRGKFLLSTLEGFRSACRLAIEFQSEPSAQENPFTAPSAKKEDTLEAFSEFLLSACDSLCIPMVMRHLEQTTHPALMEVFLSILHNLFVIVPHMKEKFSKKLASSSFIRLTLELKARFCSGLSHSALNQVCSNFLYYMCLNLLSAPEKTGPPSKEELSAVSELLQHGLPQISSRSPESLAFLSDRQYMEGAARQRQYCILLLFYLAYIHEDRFVSEAELFEAVQSFLLSLQDQGERPPLVVFKASIYLLAICQDKDNTLRETMVSAIRKFLEGIPDLQLVYTHHPLLLRFFLLYPELMSRYGHRVLELWFFWEESSYEELDDVTSAGQPALPASLVVLFQLLRSIPSILLILLDLIYSSPVDTAHKVLISLRTFLRRNEDIQVGGLIRGHFLLILQRLLVEHGASPSGASGNLPLLLSLLSLMQLRNVSEQELDSVAMKLLHQVSKLCGKCSPTDVDILQPSFNFLYWSLHQTTPSSQKRAAAVLLSSTGLMELLEKMLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLFMRYRSSSVLSHEEVGDVLQGVALADLSTLSNTTLQALHGFFQQLQSMGHLADHSMAQTLQASLEGLPPSTSSGQPPLQDMLCLGGVAVSLSHIRN

SEQ ID NO: 49973 - protein, 238 aa, Homo sapiens
  Payload ID: 9977
  Gene Symbol: MEI1
  Gene Name: meiotic double-stranded break formation protein 1
  Uniprot ID: Q5TIA1
  ENSP ID: ENSP00000385298
MLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLLQSMGHLADHSMAQTLQASLEGLPPSTSSGQPPLQDMLCLGGVAVSLSHIRN

SEQ ID NO: 49974 - protein, 63 aa, Homo sapiens
  Payload ID: 9977
  Gene Symbol: MEI1
  Gene Name: meiotic double-stranded break formation protein 1
  ENSP ID: ENSP00000410973
  MOD_RES (1)..(1): Any amino acid
XRSSSVLSHEELQSMGHLADHSMAQTLQASLEGLPPSTSSGQPPLQDMLCLGGVAVSLSHIRN

SEQ ID NO: 49975 - protein, 506 aa, Homo sapiens
  Payload ID: 9977
  Gene Symbol: MEI1
  Gene Name: meiotic double-stranded break formation protein 1
  ENSP ID: ENSP00000444225
MNQDGLGESAKNIEGSSGNTSLPLVLKKLLLSRDETLQVASAHCITAVLVHSPAKHASAFIHADIPEFLFEHLSSSSEVLVWSSCNCLTLLVEEPLFFSKCHTVYGIEAVVRSLQGSLKMNNIELHKQGLLLFAEILTRQPEEIKLFTSSAMCRDAGRALQEAVSSPVLEVAAEALKATSAFLRKDHQSTPPVQYGELQALLEAMLNRCAEFSQTLLSRRPLGHASSRDSEKAILQRGKFLLSTLEGFRSACRLAIEFQSEPSAQENPFTAPSAKKEDTLEAFSEFLLSACDSLCIPMVMRHLEQTTHPALMEVFLSILHNLFVIVPHMKEKFSKKLASSSFIRLTLELKARFCSGLSHSALNQVCSNFLYYMCLNLLSAPEKTGPPSKEELSAVSELLQHGLPQISSRSPESLAFLSDRQYMEGAARQRQYCILLLFYLAYIHEDRFVSEAELFEAVQSFLLSLQDQGERPPLVVFKASIYLLAICQDKDNTLREQLHCSLISIS

SEQ ID NO: 49976 - protein, 385 aa, Homo sapiens
  Payload ID: 9978
  Gene Symbol: MEI4
  Gene Name: meiotic double-stranded break formation protein 4
  Uniprot ID: A8MW99
  ENSP ID: ENSP00000473370
MDVQKWYLRTSKLALALAIIRSKPADKSSREYTEHLAMLLSEEQSKWRSKVEILEAEVMQLRQKLLVSRLCSGSFKSGYVSSQLEAQEPKSSESTLTSMEDSGCDLSNEQRTESSDLSQHFVESCTPTHFPPLPLVKRPCAILQNPLSSHMQFLQYLLELKNLTESGNLKRDLTHFEKDSSTVSDSVFQLLDGLITFYRNPKLPFSRFWTEAVGTLASLISDYNLSSHILKKCSKKLEEFEKTLLHAILGNNHINQFQVQHYVSQSLVTLGNCSLLRKSIISLLLSEVNGFADDLGAINQEQASYDVSRYENIFYLFWVLEQLLQKETEEGNTSSIGHDDQEIKKFLQKHDETIFQLSDAFPLFTFYLWRVGILLSSAQIETLRK

SEQ ID NO: 49977 - protein, 333 aa, Homo sapiens
  Payload ID: 9979
  Gene Symbol: MEIKIN
  Gene Name: meiotic kinetochore factor
  ENSP ID: ENSP00000481155
MWPLRVYTRKKREGQRLNLTPTPDLGSPAKAEAPPGSKRKGKVHGLSKIAEKAERSRQGGSGSGPFSPRLGVTGEKSLQENRSSEDTQDEKIASLRESVTDDLQVDSSSSNSELVSGLSLHHGMASSLLSYSVTDSYAEYKSFEESFPSPELFRKSDYLDWECPNLEEHMQWKNSTLLDTSKAVAIEKAPQFSNVSAIFSTSSEDYQKCHRKTVMTVADQNVSPKAKCASNSESDNAACEILLAEKTCPSTPEKTKKKKTNSSTPGKKNRGLLTSTPSSETAGFVFPANASEICCIIRTSPGTRQVKNKGVIVKKKKYSLPKDTPQDIIIKMA

SEQ ID NO: 49978 - protein, 104 aa, Homo sapiens
  Payload ID: 9979
  Gene Symbol: MEIKIN
  Gene Name: meiotic kinetochore factor
  ENSP ID: ENSP00000488457
  MOD_RES (1)..(1): Any amino acid
XRKLALQPLKKQRKKQIDLSSVQKASFEELFPNVSNYVNSNEIVPVSSLQENSSNEFPANASEICCIIRTSPGTRQVKNKGVIVKKKKYSLPKDTPQDIIIKMA

SEQ ID NO: 49979 - protein, 373 aa, Homo sapiens
  Payload ID: 9979
  Gene Symbol: MEIKIN
  Gene Name: meiotic kinetochore factor
  Uniprot ID: A0A087WXM9
  ENSP ID: ENSP00000488568
MWPLRVYTRKKREGQRLNLTPTPDLGSPAKAEAPPGSKRKGKVHGLSKIAEKAERSRQGGSGSGPFSPRLGVTGEKSLQENRSSEDTQDEKIASLRESVTDDLQVDSSSSNSELVSGLSLHHGMASSLLSYSVTDSYAEYKSFEESFPSPELFRKSDYLDWECPNLEEHMQWKNSTLLDTSKAVAIEKAPQFSNVSAIFSTSSEDYQKCHRKTVMTVADQNVSPKAKCASNSESDNAACEILLAEKTCPSTPEKTKKKKTNSSTPGKKNRGLLTSTPSSETAGFVIDLSSVQKASFEELFPNVSNYVNSNEIVPVSSLQENSSNEFPANASEICCIIRTSPGTRQVKNKGVIVKKKKYSLPKDTPQDIIIKMA

SEQ ID NO: 49980 - protein, 205 aa, Homo sapiens
  Payload ID: 9980
  Gene Symbol: MND1
  Gene Name: meiotic nuclear divisions 1
  Uniprot ID: Q9BWT6
  ENSP ID: ENSP00000240488
MSKKKGLSAEEKRTRMMEIFSETKDVFQLKDLEKIAPKEKGITAMSVKEVLQSLVDDGMVDCERIGTSNYYWAFPSKALHARKHKLEVLESQLSEGSQKHASLQKSIEKAKIGRCETEERTRLAKELSSLRDQREQLKAEVEKYKDCDPQVVEEIRQANKVAKEAANRWTDNIFAIKSWAKRKFGFEENKIDRTFGIPEDFDYID

SEQ ID NO: 49981 - protein, 165 aa, Homo sapiens
  Payload ID: 9980
  Gene Symbol: MND1
  Gene Name: meiotic nuclear divisions 1
  ENSP ID: ENSP00000422933
MMEIFSETKDVFQLKDLEKIAPKEKGITAMSVKEVLQSLVDDGMVDCERIGTSNYYWAFPSKALHARKHKLEVLESQLSEGSQKHASLQKSIEKAKIGRCETEERTRLAKELSSLRDQREQLKAEVEKYKDCDPQVVEEIRQANKVAKEAANRWTGMYYNNADKL

SEQ ID NO: 49982 - protein, 102 aa, Homo sapiens
  Payload ID: 9980
  Gene Symbol: MND1
  Gene Name: meiotic nuclear divisions 1
  ENSP ID: ENSP00000425500
MMEIFSETKDVFQLKDLEKIAPKEKGITAMSVKEVLQSLVDDGMVDCERIGTSNYYWAFPSKALHARKHKLEVLESQLSEGSQKHASLQKSIEKAKIGRCET

SEQ ID NO: 49983 - protein, 126 aa, Homo sapiens
  Payload ID: 9980
  Gene Symbol: MND1
  Gene Name: meiotic nuclear divisions 1
  ENSP ID: ENSP00000427559
MSKKKGLSAEEKRTRMMEIFSETKDVFQLKDLEKIAPKEKGITAMSVKEVLQSLVDDGMVDCERIGTSNYYWAFPSKALHARKHKLEVLESQDPGCCFHEIIKVSYYRKFWLGAVAHACNPSTLGG

SEQ ID NO: 49984 - protein, 122 aa, Homo sapiens
  Payload ID: 9980
  Gene Symbol: MND1
  Gene Name: meiotic nuclear divisions 1
  ENSP ID: ENSP00000477758
MSKKKGLSAEEKRTRMMEIFSETKDVFQLKDLEKIAPKEKGITAMSVKEVLQSLVDDGMVDCERIGTSNYYWAFPSKALHARKHKLEVLESQLSEGSQKHASLQKSIEKAKIGRCETAKQIK

SEQ ID NO: 49985 - protein, 390 aa, Homo sapiens
  Payload ID: 9981
  Gene Symbol: MEIS1
  Gene Name: Meis homeobox 1
  Uniprot ID: O00470
  ENSP ID: ENSP00000272369
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 49986 - protein, 463 aa, Homo sapiens
  Payload ID: 9981
  Gene Symbol: MEIS1
  Gene Name: Meis homeobox 1
  Uniprot ID: O00470
  ENSP ID: ENSP00000381518
MQYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGLQSMPGEYVARGGPMGVSMGQPSYTQPQMPPHPAQLRHGPPMHTYIPGHPHHPTVMMHGGPPHPGMPMSASSPTVLNTGDPTMSGQVMDIHAQ

SEQ ID NO: 49987 - protein, 121 aa, Homo sapiens
  Payload ID: 9981
  Gene Symbol: MEIS1
  Gene Name: Meis homeobox 1
  ENSP ID: ENSP00000397418
  MOD_RES (1)..(1): Any amino acid
XLCFESPEISRPVFPCLQMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQ

SEQ ID NO: 49988 - protein, 325 aa, Homo sapiens
  Payload ID: 9981
  Gene Symbol: MEIS1
  Gene Name: Meis homeobox 1
  ENSP ID: ENSP00000440571
MAQGLRLQGSRRKGRHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 49989 - protein, 370 aa, Homo sapiens
  Payload ID: 9981
  Gene Symbol: MEIS1
  Gene Name: Meis homeobox 1
  ENSP ID: ENSP00000454209
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAGKSPIVTVFKSRKRKPSSSHSPGGPLPGK

SEQ ID NO: 49990 - protein, 378 aa, Homo sapiens
  Payload ID: 9981
  Gene Symbol: MEIS1
  Gene Name: Meis homeobox 1
  ENSP ID: ENSP00000475161
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGKTLFLW

SEQ ID NO: 49991 - protein, 302 aa, Homo sapiens
  Payload ID: 9982
  Gene Symbol: MEIS2
  Gene Name: Meis homeobox 2
  Uniprot ID: O14770
  ENSP ID: ENSP00000326296
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTVY

SEQ ID NO: 49992 - protein, 381 aa, Homo sapiens
  Payload ID: 9982
  Gene Symbol: MEIS2
  Gene Name: Meis homeobox 2
  Uniprot ID: O14770
  ENSP ID: ENSP00000339549
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 49993 - protein, 470 aa, Homo sapiens
  Payload ID: 9982
  Gene Symbol: MEIS2
  Gene Name: Meis homeobox 2
  Uniprot ID: O14770
  ENSP ID: ENSP00000341400
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 49994 - protein, 306 aa, Homo sapiens
  Payload ID: 9982
  Gene Symbol: MEIS2
  Gene Name: Meis homeobox 2
  Uniprot ID: O14770
  ENSP ID: ENSP00000380745
MALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 49995 - protein, 306 aa, Homo sapiens; identical to SEQ ID NO: 49994
  Payload ID: 9982
  Gene Symbol: MEIS2
  Gene Name: Meis homeobox 2
  Uniprot ID: O14770
  ENSP ID: ENSP00000380749

SEQ ID NO: 49996 - protein, 401 aa, Homo sapiens
  Payload ID: 9982
  Gene Symbol: MEIS2
  Gene Name: Meis homeobox 2
  Uniprot ID: O14770
  ENSP ID: ENSP00000404185
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGPMSGMGMNMGMDGQWHYM

SEQ ID NO: 49997 - protein, 381 aa, Homo sapiens; identical to SEQ ID NO: 49992
  Payload ID: 9982
  Gene Symbol: MEIS2
  Gene Name: Meis homeobox 2
  Uniprot ID: O14770
  ENSP ID: ENSP00000452693

SEQ ID NO: 49998 - protein, 94 aa, Homo sapiens
  Payload ID: 9982
  Gene Symbol: MEIS2
  Gene Name: Meis homeobox 2
  ENSP ID: ENSP00000452770
MIQAIQVLRFHLLELEKVHELCDNFCHRYISCLKGKMPIDLVIDERDGSSKSDHEELSGSSTNLADHNPSSWRDHDDATSTHSAGTPGPSSGGH

SEQ ID NO: 49999 - protein, 105 aa, Homo sapiens
  Payload ID: 9982
  Gene Symbol: MEIS2
  Gene Name: Meis homeobox 2
  ENSP ID: ENSP00000452874
MIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQ

SEQ ID NO: 50000 - protein, 388 aa, Homo sapiens
  Payload ID: 9982
  Gene Symbol: MEIS2
  Gene Name: Meis homeobox 2
  Uniprot ID: O14770
  ENSP ID: ENSP00000453390
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGPMSGMGMNMGMDGQWHYM

SEQ ID NO: 50001 - protein, 98 aa, Homo sapiens
  Payload ID: 9982
  Gene Symbol: MEIS2
  Gene Name: Meis homeobox 2
  ENSP ID: ENSP00000453481
MAQRYDELPHYGGMDGVGVPASMYGDPHAPRPIPPVHHLNHGPPLHATQHYGAHAPHPNVMPASMGSAVNDALKRDKDAIYGFAPKSHFFPQIQSWTI

SEQ ID NO: 50002 - protein, 394 aa, Homo sapiens
  Payload ID: 9982
  Gene Symbol: MEIS2
  Gene Name: Meis homeobox 2
  Uniprot ID: O14770
  ENSP ID: ENSP00000453497
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 50003 - protein, 157 aa, Homo sapiens
  Payload ID: 9982
  Gene Symbol: MEIS2
  Gene Name: Meis homeobox 2
  ENSP ID: ENSP00000453782
MALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSG

SEQ ID NO: 50004 - protein, 477 aa, Homo sapiens
  Payload ID: 9982
  Gene Symbol: MEIS2
  Gene Name: Meis homeobox 2
  Uniprot ID: O14770
  ENSP ID: ENSP00000453793
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 50005 - protein, 139 aa, Homo sapiens
  Payload ID: 9982
  Gene Symbol: MEIS2
  Gene Name: Meis homeobox 2
  ENSP ID: ENSP00000475660
IQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQEFFRFIPIFQMKWLGLGEGQLLDCHDRKRKQKNEDKAI

SEQ ID NO: 50006 - protein, 235 aa, Homo sapiens
  Payload ID: 9982
  Gene Symbol: MEIS2
  Gene Name: Meis homeobox 2
  ENSP ID: ENSP00000475899
EGFRWMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAG

SEQ ID NO: 50007 - protein, 404 aa, Homo sapiens
  Payload ID: 9983
  Gene Symbol: MEIS3
  Gene Name: Meis homeobox 3
  ENSP ID: ENSP00000333552
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSRRSEAPVLPDVCLGLGSPSPGPRWARPWGSDCGRPGRQSDSCWWLQHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 50008 - protein, 358 aa, Homo sapiens
  Payload ID: 9983
  Gene Symbol: MEIS3
  Gene Name: Meis homeobox 3
  Uniprot ID: Q99687
  ENSP ID: ENSP00000388667
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 50009 - protein, 421 aa, Homo sapiens
  Payload ID: 9983
  Gene Symbol: MEIS3
  Gene Name: Meis homeobox 3
  Uniprot ID: Q99687
  ENSP ID: ENSP00000452854
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSRRSEAPVLPDVCLGLGSPSPGPRWARPWGSDCGRPGRQSDSCWWLQHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 50010 - protein, 177 aa, Homo sapiens
  Payload ID: 9983
  Gene Symbol: MEIS3
  Gene Name: Meis homeobox 3
  ENSP ID: ENSP00000453249
  MOD_RES (1)..(1): Any amino acid
XGLSLPSQVRSERPLFSSNPELDNLGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSRRSEAPVLPDVCLGLGSPSPGPRWARPWGSDC

SEQ ID NO: 50011 - protein, 421 aa, Homo sapiens; identical to SEQ ID NO: 50009
  Payload ID: 9983
  Gene Symbol: MEIS3
  Gene Name: Meis homeobox 3
  Uniprot ID: Q99687
  ENSP ID: ENSP00000453307

SEQ ID NO: 50012 - protein, 250 aa, Homo sapiens
  Payload ID: 9983
  Gene Symbol: MEIS3
  Gene Name: Meis homeobox 3
  ENSP ID: ENSP00000453757
PPPSLSTPALPPWVAPPSTPVPPQVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 50013 - protein, 463 aa, Homo sapiens
  Payload ID: 9983
  Gene Symbol: MEIS3
  Gene Name: Meis homeobox 3
  ENSP ID: ENSP00000453934
MCTLCTTMRGSYRRCPWISLSVCLSLCLCHCLLTPLSPSLFPPSQTLPSLPLGPPAHMSGISAWTGSSLPTEAAPGDLEGFKLGGSDTWGPQYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 50014 - protein, 375 aa, Homo sapiens
  Payload ID: 9983
  Gene Symbol: MEIS3
  Gene Name: Meis homeobox 3
  Uniprot ID: Q99687
  ENSP ID: ENSP00000454073
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 50015 - protein, 126 aa, Homo sapiens
  Payload ID: 9983
  Gene Symbol: MEIS3
  Gene Name: Meis homeobox 3
  ENSP ID: ENSP00000475941
FPKVATNIMRAWLFQHLSAGAGRHVIAPSLRLPWSPSWGAQRRSEAPVLPDVCLGLGSPSPGPRWARPWGSDCGRPGRQSDSCWWLQHPYPSEEQKKQLAQDTGLTILQVNNWFINARRRIVQPMI

SEQ ID NO: 50016 - protein, 220 aa, Homo sapiens
  Payload ID: 9983
  Gene Symbol: MEIS3
  Gene Name: Meis homeobox 3
  ENSP ID: ENSP00000476248
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVSASHLPTPSLAPVIPPPLVASAPHLPALSPPELKQNAAPVPEHPRPAPVGGPPQYPGAPPGPRPVRQLLS

SEQ ID NO: 50017 - protein, 118 aa, Homo sapiens
  Payload ID: 9984
  Gene Symbol: MLANA
  Gene Name: melan-A
  Uniprot ID: Q16655
  ENSP ID: ENSP00000370880
MPREDAHFIYGYPKKGHGHSYTTAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 50018 - protein, 118 aa, Homo sapiens; identical to SEQ ID NO: 50017
  Payload ID: 9984
  Gene Symbol: MLANA
  Gene Name: melan-A
  Uniprot ID: Q16655
  ENSP ID: ENSP00000370885

SEQ ID NO: 50019 - protein, 118 aa, Homo sapiens; identical to SEQ ID NO: 50017
  Payload ID: 9984
  Gene Symbol: MLANA
  Gene Name: melan-A
  Uniprot ID: Q16655
  ENSP ID: ENSP00000370886

SEQ ID NO: 50020 - protein, 422 aa, Homo sapiens
  Payload ID: 9985
  Gene Symbol: MCHR1
  Gene Name: melanin-concentrating hormone receptor 1
  Uniprot ID: Q99705
  ENSP ID: ENSP00000249016
MSVGAMKKGVGRAVGLGGGSGCQATEEDPLPNCGACAPGQGGRRWRLPQPAWVEGSSARLWEQATGTGWMDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 50021 - protein, 296 aa, Homo sapiens
  Payload ID: 9985
  Gene Symbol: MCHR1
  Gene Name: melanin-concentrating hormone receptor 1
  ENSP ID: ENSP00000370841
MSVGAMKKGVGRAVGLGGGSGCQATEEDPLPNCGACAPGQGGRRWRLPQPAWVEGSSARLWEQATGTGWMDLEASLLPTGPNASNTSDGPDNLTSAGSPPRTGSISYINIIMPSVFGTICLLGIIGNSTVIFAVVKKSKLHWCNNVPDIFIINLSFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 50022 - protein, 340 aa, Homo sapiens
  Payload ID: 9986
  Gene Symbol: MCHR2
  Gene Name: melanin-concentrating hormone receptor 2
  Uniprot ID: Q969V1
  ENSP ID: ENSP00000281806
MNPFHASCWNTSAELLNKSWNKEFAYQTASVVDTVILPSMIGIICSTGLVGNILIVFTIIRSRKKTVPDIYICNLAVADLVHIVGMPFLIHQWARGGEWVFGGPLCTIITSLDTCNQFACSAIMTVMSVDRYFALVQPFRLTRWRTRYKTIRINLGLWAASFILALPVWVYSKVIKFKDGVESCAFDLTSPDDVLWYTLYLTITTFFFPLPLILVCYILILCYTWEMYQQNKDARCCNPSVPKQRVMKLTKMVLVLVVVFILSAAPYHVIQLVNLQMEQPTLAFYVGYYLSICLSYASSSINPFLYILLSGNFQKRLPQIQRRATEKEINNMGNTLKSHF

SEQ ID NO: 50023 - protein, 340 aa, Homo sapiens; identical to SEQ ID NO: 50022
  Payload ID: 9986
  Gene Symbol: MCHR2
  Gene Name: melanin-concentrating hormone receptor 2
  Uniprot ID: Q969V1
  ENSP ID: ENSP00000358214

SEQ ID NO: 50024 - protein, 317 aa, Homo sapiens
  Payload ID: 9987
  Gene Symbol: MC1R
  Gene Name: melanocortin 1 receptor (alpha melanocyte stimulating hormone receptor)
  Uniprot ID: Q01726
  ENSP ID: ENSP00000451605
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 50025 - protein, 382 aa, Homo sapiens
  Payload ID: 9987
  Gene Symbol: MC1R
  Gene Name: melanocortin 1 receptor (alpha melanocyte stimulating hormone receptor)
  ENSP ID: ENSP00000451760
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSCSQDRALVSWDVKSLGGSVCQELLPQQPQEKGLCDQKASSTALQRLLQKEVKSLPQAKGPGLQEPP

SEQ ID NO: 50026 - protein, 297 aa, Homo sapiens
  Payload ID: 9988
  Gene Symbol: MC2R
  Gene Name: melanocortin 2 receptor (adrenocorticotropic hormone)
  Uniprot ID: Q01718
  ENSP ID: ENSP00000333821
MKHIINSYENINNTARNNSDCPRVVLPEEIFFTISIVGVLENLIVLLAVFKNKNLQAPMYFFICSLAISDMLGSLYKILENILIILRNMGYLKPRGSFETTADDIIDSLFVLSLLGSIFSLSVIAADRYITIFHALRYHSIVTMRRTVVVLTVIWTFCTGTGITMVIFSHHVPTVITFTSLFPLMLVFILCLYVHMFLLARSHTRKISTLPRANMKGAITLTILLGVFIFCWAPFVLHVLLMTFCPSNPYCACYMSLFQVNGMLIMCNAVIDPFIYAFRSPELRDAFKKMIFCSRYW

SEQ ID NO: 50027 - protein, 123 aa, Homo sapiens
  Payload ID: 9988
  Gene Symbol: MC2R
  Gene Name: melanocortin 2 receptor (adrenocorticotropic hormone)
  ENSP ID: ENSP00000382718
MKHIINSYENINNTARNNSDCPRVVLPEEIFFTISIVGVLENLIVLLAVFKNKNLQAPMYFFICSLAISDMLGSLYKILENILIILRNMGYLKPRGSFETTADDIIDSLFVLSLLGSIFSLSV

SEQ ID NO: 50028 - protein, 172 aa, Homo sapiens
  Payload ID: 9989
  Gene Symbol: MRAP
  Gene Name: melanocortin 2 receptor accessory protein
  Uniprot ID: Q8TCY5
  ENSP ID: ENSP00000306697
MANGTNASAPYYSYEYYLDYLDLIPVDEKKLKAHKHSIVIAFWVSLAAFVVLLFLILLYMSWSASPQMRNSPKHHQTCPWSHGLNLHLCIQKCLPCHREPLATSQAQASSVEPGSRTGPDQPLRQESSSTLPLGGFQTHPTLLWELTLNGGPLVRSKPSEPPPGDRTSQLQS

SEQ ID NO: 50029 - protein, 102 aa, Homo sapiens
  Payload ID: 9989
  Gene Symbol: MRAP
  Gene Name: melanocortin 2 receptor accessory protein
  Uniprot ID: Q8TCY5
  ENSP ID: ENSP00000343661
MANGTNASAPYYSYEYYLDYLDLIPVDEKKLKAHKHSIVIAFWVSLAAFVVLLFLILLYMSWSASPQMSFNTDESLLHSEVLPQTRAISCDELQAPREEGAA

SEQ ID NO: 50030 - protein, 172 aa, Homo sapiens; identical to SEQ ID NO: 50028
  Payload ID: 9989
  Gene Symbol: MRAP
  Gene Name: melanocortin 2 receptor accessory protein
  Uniprot ID: Q8TCY5
  ENSP ID: ENSP00000382684

SEQ ID NO: 50031 - protein, 205 aa, Homo sapiens
  Payload ID: 9990
  Gene Symbol: MRAP2
  Gene Name: melanocortin 2 receptor accessory protein 2
  Uniprot ID: Q96G30
  ENSP ID: ENSP00000257776
MSAQRLISNRTSQQSASNSDYTWEYEYYEIGPVSFEGLKAHKYSIVIGFWVGLAVFVIFMFFVLTLLTKTGAPHQDNAESSEKRFRMNSFVSDFGRPLEPDKVFSRQGNEESRSLFHCYINEVERLDRAKACHQTTALDSDVQLQEAIRSSGQPEEELNRLMKFDIPNFVNTDQNYFGEDDLLISEPPIVLETKPLSQTSHKDLD

SEQ ID NO: 50032 - protein, 323 aa, Homo sapiens
  Payload ID: 9991
  Gene Symbol: MC3R
  Gene Name: melanocortin 3 receptor
  Uniprot ID: P41968
  ENSP ID: ENSP00000243911
MNASCCLPSVQPTLPNGSEHLQAPFFSNQSSSAFCEQVFIKPEVFLSLGIVSLLENILVILAVVRNGNLHSPMYFFLCSLAVADMLVSVSNALETIMIAIVHSDYLTFEDQFIQHMDNIFDSMICISLVASICNLLAIAVDRYVTIFYALRYHSIMTVRKALTLIVAIWVCCGVCGVVFIVYSESKMVIVCLITMFFAMMLLMGTLYVHMFLFARLHVKRIAALPPADGVAPQQHSCMKGAVTITILLGVFIFCWAPFFLHLVLIITCPTNPYCICYTAHFNTYLVLIMCNSVIDPLIYAFRSLELRNTFREILCGCNGMNLG

SEQ ID NO: 50033 - protein, 332 aa, Homo sapiens [sequence omitted]

SEQ ID NO: 50034 - protein, 325 aa, Homo sapiens
  Payload ID: 9993
  Gene Symbol: MC5R
  Gene Name: melanocortin 5 receptor
  Uniprot ID: P33032
  ENSP ID: ENSP00000318077
MNSSFHLHFLDLNLNATEGNLSGPNVKNKSSPCEDMGIAVEVFLTLGVISLLENILVIGAIVKNKNLHSPMYFFVCSLAVADMLVSMSSAWETITIYLLNNKHLVIADAFVRHIDNVFDSMICISVVASMCSLLAIAVDRYVTIFYALRYHHIMTARRSGAIIAGIWAFCTGCGIVFILYSESTYVILCLISMFFAMLFLLVSLYIHMFLLARTHVKRIAALPGASSARQRTSMQGAVTVTMLLGVFTVCWAPFFLHLTLMLSCPQNLYCSRFMSHFNMYLILIMCNSVMDPLIYAFRSQEMRKTFKEIICCRGFRIACSFPRRD

SEQ ID NO: 50035 - protein, 173 aa, Homo sapiens
  Payload ID: 9993
  Gene Symbol: MC5R
  Gene Name: melanocortin 5 receptor
  ENSP ID: ENSP00000468086
MNSSFHLHFLDLNLNATEGNLSGPNVKNKSSPCEDMGIAVEVFLTLGVISLLENILVIGAIVKNKNLHSPMYFFVCSLAVADMLVSMSSAWETITIYLLNNKHLVIADAFVRHIDNVFDSMICISVVASMCSLLAIAVDRYVTIFYALRYHHIMTARRSGAIIAGIWAFCTGC

SEQ ID NO: 50036 - protein, 309 aa, Homo sapiens
  Payload ID: 9994
  Gene Symbol: MAGEA1
  Gene Name: melanoma antigen family A1
  Uniprot ID: P43355
  ENSP ID: ENSP00000349085
MSLEQRSLHCKPEEALEAQQEALGLVCVQAATSSSSPLVLGTLEEVPTAGSTDPPQSPQGASAFPTTINFTRQRQPSEGSSSREEEGPSTSCILESLFRAVITKKVADLVGFLLLKYRAREPVTKAEMLESVIKNYKHCFPEIFGKASESLQLVFGIDVKEADPTGHSYVLVTCLGLSYDGLLGDNQIMPKTGFLIIVLVMIAMEGGHAPEEEIWEELSVMEVYDGREHSAYGEPRKLLTQDLVQEKYLEYRQVPDSDPARYEFLWGPRALAETSYVKVLEYVIKVSARVRFFFPSLREAALREEEEGV

SEQ ID NO: 50037 - protein, 369 aa, Homo sapiens
  Payload ID: 9995
  Gene Symbol: MAGEA10
  Gene Name: melanoma antigen family A10
  Uniprot ID: P43363
  ENSP ID: ENSP00000244096
MPRAPKRQRCMPEEDLQSQSETQGLEGAQAPLAVEEDASSSTSTSSSFPSSFPSSSSSSSSSCYPLIPSTPEEVSADDETPNPPQSAQIACSSPSVVASLPLDQSDEGSSSQKEESPSTLQVLPDSESLPRSEIDEKVTDLVQFLLFKYQMKEPITKAEILESVIRNYEDHFPLLFSEASECMLLVFGIDVKEVDPTGHSFVLVTSLGLTYDGMLSDVQSMPKTGILILILSIVFIEGYCTPEEVIWEALNMMGLYDGMEHLIYGEPRKLLTQDWVQENYLEYRQVPGSDPARYEFLWGPRAHAEIRKMSLLKFLAKVNGSDPRSFPLWYEEALKDEEERAQDRIATTDDTTAMASASSSATGSFSYPE

SEQ ID NO: 50038 - protein, 369 aa, Homo sapiens; identical to SEQ ID NO: 50037
  Payload ID: 9995
  Gene Symbol: MAGEA10
  Gene Name: melanoma antigen family A10
  Uniprot ID: P43363
  ENSP ID: ENSP00000359347

SEQ ID NO: 50039 - protein, 161 aa, Homo sapiens
  Payload ID: 9995
  Gene Symbol: MAGEA10
  Gene Name: melanoma antigen family A10
  ENSP ID: ENSP00000391977
MPRAPKRQRCMPEEDLQSQSETQGLEGAQAPLAVEEDASSSTSTSSSFPSSFPSSSSSSSSSCYPLIPSTPEEVSADDETPNPPQSAQIACSSPSVVASLPLDQSDEGSSSQKEESPSTLQVLPDSESLPRSEIDEKVTDLVQFLLFKYQMKEPITKAEIL

SEQ ID NO: 50040 - protein, 184 aa, Homo sapiens
  Payload ID: 9995
  Gene Symbol: MAGEA10
  Gene Name: melanoma antigen family A10
  ENSP ID: ENSP00000406161
MPRAPKRQRCMPEEDLQSQSETQGLEGAQAPLAVEEDASSSTSTSSSFPSSFPSSSSSSSSSCYPLIPSTPEEVSADDETPNPPQSAQIACSSPSVVASLPLDQSDEGSSSQKEESPSTLQVLPDSESLPRSEIDEKVTDLVQFLLFKYQMKEPITKAEILESVIRNYEDHFPLLFSEASECML

SEQ ID NO: 50041 - protein, 58 aa, Homo sapiens
  Payload ID: 9995
  Gene Symbol: MAGEA10
  Gene Name: melanoma antigen family A10
  ENSP ID: ENSP00000462833
MPRAPKRQRCMPEEDLQSQSETQGLEGAQAPLAVEEDASSSTSTSSSFPSSFPSSSSS

SEQ ID NO: 50042 - protein, 71 aa, Homo sapiens
  Payload ID: 9995
  Gene Symbol: MAGEA10
  Gene Name: melanoma antigen family A10
  ENSP ID: ENSP00000464160
MPRAPKRQRCMPEEDLQSQSETQGLEGAQAPLAVEEDASSSTSTSSSFPSSFPSSSSSSSSSCYPLIPSTP

SEQ ID NO: 50043 - protein, 400 aa, Homo sapiens
  Payload ID: 9996
  Gene Symbol: MAGEA11
  Gene Name: melanoma antigen family A11
  ENSP ID: ENSP00000328177
MSKVSTMFSEDDFQSTERAPYGPQLQWSQDLPRVQVFREQANLEDRSPRRTQRITGGEQVLWGPITQIFPTVRPADLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSTSPDLIDPESFSQDILHDKIIDLVHLLLRKYRVKGLITKAEMLGSVIKNYEDYFPEIFREASVCMQLLFGIDVKEVDPTSHSYVLVTSLNLSYDGIQCNEQSMPKSGLLIIVLGVIFMEGNCIPEEVMWEVLSIMGVYAGREHFLFGEPKRLLTQNWVQEKYLVYRQVPGTDPACYEFLWGPRAHAETSKMKVLEYIANANGRDPTSYPSLYEDALREEGEGV

SEQ ID NO: 50044 - protein, 429 aa, Homo sapiens
  Payload ID: 9996
  Gene Symbol: MAGEA11
  Gene Name: melanoma antigen family A11
  Uniprot ID: P43364
  ENSP ID: ENSP00000347358
METQFRRGGLGCSPASIKRKKKREDSGDFGLQVSTMFSEDDFQSTERAPYGPQLQWSQDLPRVQVFREQANLEDRSPRRTQRITGGEQVLWGPITQIFPTVRPADLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSTSPDLIDPESFSQDILHDKIIDLVHLLLRKYRVKGLITKAEMLGSVIKNYEDYFPEIFREASVCMQLLFGIDVKEVDPTSHSYVLVTSLNLSYDGIQCNEQSMPKSGLLIIVLGVIFMEGNCIPEEVMWEVLSIMGVYAGREHFLFGEPKRLLTQNWVQEKYLVYRQVPGTDPACYEFLWGPRAHAETSKMKVLEYIANANGRDPTSYPSLYEDALREEGEGV

SEQ ID NO: 50045 - protein, 295 aa, Homo sapiens
  Payload ID: 9996
  Gene Symbol: MAGEA11
  Gene Name: melanoma antigen family A11
  ENSP ID: ENSP00000391496
MSKVSTMFSEDDFQSTERAPYGPQLQWSQDLPRVQVFREQANLEDRSPRRTQRITGGEQVLWGPITQIFPTVRPADLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSTSPDLIDPESFSQDILHDKIIDLVHLLLRKYRVKGLITKAEMLGSVIKNYEDYFPEIFREASVCMQLLFGIDVKEVDPTSHSYVLVTSLNLSYDGIQCNEQSMPKSGLLIIVLGVIFM

SEQ ID NO: 50046 - protein, 314 aa, Homo sapiens
  Payload ID: 9997
  Gene Symbol: MAGEA12
  Gene Name: melanoma antigen family A12
  Uniprot ID: P43365
  ENSP ID: ENSP00000350592
MPLEQRSQHCKPEEGLEAQGEALGLVGAQAPATEEQETASSSSTLVEVTLREVPAAESPSPPHSPQGASTLPTTINYTLWSQSDEGSSNEEQEGPSTFPDLETSFQVALSRKMAELVHFLLLKYRAREPFTKAEMLGSVIRNFQDFFPVIFSKASEYLQLVFGIEVVEVVRIGHLYILVTCLGLSYDGLLGDNQIVPKTGLLIIVLAIIAKEGDCAPEEKIWEELSVLEASDGREDSVFAHPRKLLTQDLVQENYLEYRQVPGSDPACYEFLWGPRALVETSYVKVLHHLLKISGGPHISYPPLHEWAFREGEE

SEQ ID NO: 50047 - protein, 314 aa, Homo sapiens; identical to SEQ ID NO: 50046
  Payload ID: 9997
  Gene Symbol: MAGEA12
  Gene Name: melanoma antigen family A12
  Uniprot ID: P43365
  ENSP ID: ENSP00000377447

SEQ ID NO: 50048 - protein, 314 aa, Homo sapiens; identical to SEQ ID NO: 50046
  Payload ID: 9997
  Gene Symbol: MAGEA12
  Gene Name: melanoma antigen family A12
  Uniprot ID: P43365
  ENSP ID: ENSP00000377478

SEQ ID NO: 50049 - protein, 314 aa, Homo sapiens
  Payload ID: 9998
  Gene Symbol: MAGEA2
  Gene Name: melanoma antigen family A2
  Uniprot ID: P43356
  ENSP ID: ENSP00000469919
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLSYDGLLGDNQVMPKTGLLIIVLAIIAIEGDCAPEEKIWEELSMLEVFEGREDSVFAHPRKLLMQDLVQENYLEYRQVPGSDPACYEFLWGPRALIETSYVKVLHHTLKIGGEPHISYPPLHERALREGEE

SEQ ID NO: 50050 - protein, 314 aa, Homo sapiens; identical to SEQ ID NO: 50049
  Payload ID: 9998
  Gene Symbol: MAGEA2
  Gene Name: melanoma antigen family A2
  Uniprot ID: P43356
  ENSP ID: ENSP00000470872

SEQ ID NO: 50051 - protein, 314 aa, Homo sapiens; identical to SEQ ID NO: 50049
  Payload ID: 9998
  Gene Symbol: MAGEA2
  Gene Name: melanoma antigen family A2
  Uniprot ID: P43356
  ENSP ID: ENSP00000480491

SEQ ID NO: 50052 - protein, 314 aa, Homo sapiens; identical to SEQ ID NO: 50049
  Payload ID: 9998
  Gene Symbol: MAGEA2
  Gene Name: melanoma antigen family A2
  Uniprot ID: P43356
  ENSP ID: ENSP00000480738

SEQ ID NO: 50053 - protein, 80 aa, Homo sapiens
  Payload ID: 9998
  Gene Symbol: MAGEA2
  Gene Name: melanoma antigen family A2
  ENSP ID: ENSP00000482879
MPLEQRSQHCKPEEGLEARGEALGLVGAQAPATEEQQTASSSSTLVEVTLGEVPAADSPSPPHSPQGASSFSTTINYTLW

SEQ ID NO: 50054 - protein, 37 aa, Homo sapiens
  Payload ID: 9998
  Gene Symbol: MAGEA2
  Gene Name: melanoma antigen family A2
  ENSP ID: ENSP00000483352
MPLEQRSQHCKPEEGLEARGEALGLVGAQAPATEEQQ

SEQ ID NO: 50055 - protein, 314 aa, Homo sapiens; identical to SEQ ID NO: 50049
  Payload ID: 9998
  Gene Symbol: MAGEA2
  Gene Name: melanoma antigen family A2
  Uniprot ID: P43356
  ENSP ID: ENSP00000484290

SEQ ID NO: 50056 - protein, 314 aa, Homo sapiens; identical to SEQ ID NO: 50049
  Payload ID: 9998
  Gene Symbol: MAGEA2
  Gene Name: melanoma antigen family A2
  Uniprot ID: P43356
  ENSP ID: ENSP00000485391

SEQ ID NO: 50057 - protein, 314 aa, Homo sapiens; identical to SEQ ID NO: 50049
  Payload ID: 9998
  Gene Symbol: MAGEA2
  Gene Name: melanoma antigen family A2
  Uniprot ID: P43356
  ENSP ID: ENSP00000485541

SEQ ID NO: 50058 - protein, 314 aa, Homo sapiens; identical to SEQ ID NO: 50049
  Payload ID: 9999
  Gene Symbol: MAGEA2B
  Gene Name: melanoma antigen family A2B
  Uniprot ID: P43356
  ENSP ID: ENSP00000333487

SEQ ID NO: 50059 - protein, 314 aa, Homo sapiens; identical to SEQ ID NO: 50049
  Payload ID: 9999
  Gene Symbol: MAGEA2B
  Gene Name: melanoma antigen family A2B
  Uniprot ID: P43356
  ENSP ID: ENSP00000359316

SEQ ID NO: 50060 - protein, 33 aa, Homo sapiens
  Payload ID: 9999
  Gene Symbol: MAGEA2B
  Gene Name: melanoma antigen family A2B
  ENSP ID: ENSP00000386463
MPLEQRSQHCKPEEGLEARGEALGLVGAQAPAT

SEQ ID NO: 50061 - protein, 89 aa, Homo sapiens
  Payload ID: 9999
  Gene Symbol: MAGEA2B
  Gene Name: melanoma antigen family A2B
  ENSP ID: ENSP00000389223
MPLEQRSQHCKPEEGLEARGEALGLVGAQAPATEEQQTASSSSTLVEVTLGEVPAADSPSPPHSPQGASSFSTTINYTLWRQSDEGSSN

SEQ ID NO: 50062 - protein, 37 aa, Homo sapiens; identical to SEQ ID NO: 50054
  Payload ID: 9999
  Gene Symbol: MAGEA2B
  Gene Name: melanoma antigen family A2B
  ENSP ID: ENSP00000389999

SEQ ID NO: 50063 - protein, 152 aa, Homo sapiens
  Payload ID: 9999
  Gene Symbol: MAGEA2B
  Gene Name: melanoma antigen family A2B
  ENSP ID: ENSP00000395386
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFS

SEQ ID NO: 50064 - protein, 120 aa, Homo sapiens
  Payload ID: 9999
  Gene Symbol: MAGEA2B
  Gene Name: melanoma antigen family A2B
  ENSP ID: ENSP00000397216
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFL

SEQ ID NO: 50065 - protein, 148 aa, Homo sapiens
  Payload ID: 9999
  Gene Symbol: MAGEA2B
  Gene Name: melanoma antigen family A2B
  ENSP ID: ENSP00000413384
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFP

SEQ ID NO: 50066 - protein, 314 aa, Homo sapiens
  Payload ID: 10000
  Gene Symbol: MAGEA3
  Gene Name: melanoma antigen family A3
  Uniprot ID: P43357
  ENSP ID: ENSP00000359301
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 50067 - protein, 198 aa, Homo sapiens
  Payload ID: 10000
  Gene Symbol: MAGEA3
  Gene Name: melanoma antigen family A3
  ENSP ID: ENSP00000392758
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPK

SEQ ID NO: 50068 - protein, 314 aa, Homo sapiens; identical to SEQ ID NO: 50066
  Payload ID: 10000
  Gene Symbol: MAGEA3
  Gene Name: melanoma antigen family A3
  Uniprot ID: P43357
  ENSP ID: ENSP00000473093

SEQ ID NO: 50069 - protein, 317 aa, Homo sapiens
  Payload ID: 10001
  Gene Symbol: MAGEA4
  Gene Name: melanoma antigen family A4
  Uniprot ID: P43358
  ENSP ID: ENSP00000276344
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 50070 - protein, 317 aa, Homo sapiens; identical to SEQ ID NO: 50069
  Payload ID: 10001
  Gene Symbol: MAGEA4
  Gene Name: melanoma antigen family A4
  Uniprot ID: P43358
  ENSP ID: ENSP00000353379

SEQ ID NO: 50071 - protein, 317 aa, Homo sapiens; identical to SEQ ID NO: 50069
  Payload ID: 10001
  Gene Symbol: MAGEA4
  Gene Name: melanoma antigen family A4
  Uniprot ID: P43358
  ENSP ID: ENSP00000359360

SEQ ID NO: 50072 - protein, 317 aa, Homo sapiens; identical to SEQ ID NO: 50069
  Payload ID: 10001
  Gene Symbol: MAGEA4
  Gene Name: melanoma antigen family A4
  Uniprot ID: P43358
  ENSP ID: ENSP00000359365

SEQ ID NO: 50073 - protein, 317 aa, Homo sapiens; identical to SEQ ID NO: 50069
  Payload ID: 10001
  Gene Symbol: MAGEA4
  Gene Name: melanoma antigen family A4
  Uniprot ID: P43358
  ENSP ID: ENSP00000377497

SEQ ID NO: 50074 - protein, 317 aa, Homo sapiens; identical to SEQ ID NO: 50069
  Payload ID: 10001
  Gene Symbol: MAGEA4
  Gene Name: melanoma antigen family A4
  Uniprot ID: P43358
  ENSP ID: ENSP00000377498

SEQ ID NO: 50075 - protein, 171 aa, Homo sapiens
  Payload ID: 10001
  Gene Symbol: MAGEA4
  Gene Name: melanoma antigen family A4
  ENSP ID: ENSP00000387777
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVD

SEQ ID NO: 50076 - protein, 241 aa, Homo sapiens
  Payload ID: 10001
  Gene Symbol: MAGEA4
  Gene Name: melanoma antigen family A4
  ENSP ID: ENSP00000390096
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMGVYDGREHTVYG

SEQ ID NO: 50077 - protein, 217 aa, Homo sapiens
  Payload ID: 10001
  Gene Symbol: MAGEA4
  Gene Name: melanoma antigen family A4
  ENSP ID: ENSP00000391904
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSA

SEQ ID NO: 50078 - protein, 230 aa, Homo sapiens
  Payload ID: 10001
  Gene Symbol: MAGEA4
  Gene Name: melanoma antigen family A4
  ENSP ID: ENSP00000394073
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMG

SEQ ID NO: 50079 - protein, 241 aa, Homo sapiens; identical to SEQ ID NO: 50076
  Payload ID: 10001
  Gene Symbol: MAGEA4
  Gene Name: melanoma antigen family A4
  ENSP ID: ENSP00000394149

SEQ ID NO: 50080 - protein, 217 aa, Homo sapiens; identical to SEQ ID NO: 50077
  Payload ID: 10001
  Gene Symbol: MAGEA4
  Gene Name: melanoma antigen family A4
  ENSP ID: ENSP00000400900

SEQ ID NO: 50081 - protein, 241 aa, Homo sapiens; identical to SEQ ID NO: 50076
  Payload ID: 10001
  Gene Symbol: MAGEA4
  Gene Name: melanoma antigen family A4
  ENSP ID: ENSP00000402186

SEQ ID NO: 50082 - protein, 241 aa, Homo sapiens; identical to SEQ ID NO: 50076
  Payload ID: 10001
  Gene Symbol: MAGEA4
  Gene Name: melanoma antigen family A4
  ENSP ID: ENSP00000402624

SEQ ID NO: 50083 - protein, 314 aa, Homo sapiens
  Payload ID: 10002
  Gene Symbol: MAGEA6
  Gene Name: melanoma antigen family A6
  Uniprot ID: P43360
  ENSP ID: ENSP00000329199
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAKLVHFLLLKYRAREPVTKAEMLGSVVGNWQYFFPVIFSKASDSLQLVFGIELMEVDPIGHVYIFATCLGLSYDGLLGDNQIMPKTGFLIIILAIIAKEGDCAPEEKIWEELSVLEVFEGREDSIFGDPKKLLTQYFVQENYLEYRQVPGSDPACYEFLWGPRALIETSYVKVLHHMVKISGGPRISYPLLHEWALREGEE

SEQ ID NO: 50084 - protein, 235 aa, Homo sapiens
  Payload ID: 10002
  Gene Symbol: MAGEA6
  Gene Name: melanoma antigen family A6
  ENSP ID: ENSP00000401806
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAKLVHFLLLKYRAREPVTKAEMLGSVVGNWQYFFPVIFSKASDSLQLVFGIELMEVDPIGHVYIFATCLGLSYDGLLGDNQIMPKTGFLIIILAIIAKEGDCAPEEKIWEELSVLEVFEGRE

SEQ ID NO: 50085 - protein, 201 aa, Homo sapiens
  Payload ID: 10002
  Gene Symbol: MAGEA6
  Gene Name: melanoma antigen family A6
  ENSP ID: ENSP00000403303
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAKLVHFLLLKYRAREPVTKAEMLGSVVGNWQYFFPVIFSKASDSLQLVFGIELMEVDPIGHVYIFATCLGLSYDGLLGDNQIMPKTGF

SEQ ID NO: 50086 - protein, 314 aa, Homo sapiens; identical to SEQ ID NO: 50083
  Payload ID: 10002
  Gene Symbol: MAGEA6
  Gene Name: melanoma antigen family A6
  Uniprot ID: P43360
  ENSP ID: ENSP00000480637

SEQ ID NO: 50087 - protein, 318 aa, Homo sapiens
  Payload ID: 10003
  Gene Symbol: MAGEA8
  Gene Name: melanoma antigen family A8
  Uniprot ID: P43361
  ENSP ID: ENSP00000286482
MLLGQKSQRYKAEEGLQAQGEAPGLMDVQIPTAEEQKAASSSSTLIMGTLEEVTDSGSPSPPQSPEGASSSLTVTDSTLWSQSDEGSSSNEEEGPSTSPDPAHLESLFREALDEKVAELVRFLLRKYQIKEPVTKAEMLESVIKNYKNHFPDIFSKASECMQVIFGIDVKEVDPAGHSYILVTCLGLSYDGLLGDDQSTPKTGLLIIVLGMILMEGSRAPEEAIWEALSVMGLYDGREHSVYWKLRKLLTQEWVQENYLEYRQAPGSDPVRYEFLWGPRALAETSYVKVLEHVVRVNARVRISYPSLHEEALGEEKGV

SEQ ID NO: 50088 - protein, 318 aa, Homo sapiens; identical to SEQ ID NO: 50087
  Payload ID: 10003
  Gene Symbol: MAGEA8
  Gene Name: melanoma antigen family A8
  Uniprot ID: P43361
  ENSP ID: ENSP00000438293

SEQ ID NO: 50089 - protein, 318 aa, Homo sapiens; identical to SEQ ID NO: 50087
  Payload ID: 10003
  Gene Symbol: MAGEA8
  Gene Name: melanoma antigen family A8
  Uniprot ID: P43361
  ENSP ID: ENSP00000443776

SEQ ID NO: 50090 - protein, 315 aa, Homo sapiens
  Payload ID: 10004
  Gene Symbol: MAGEA9
  Gene Name: melanoma antigen family A9
  Uniprot ID: P43362
  ENSP ID: ENSP00000243314
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSMPKAALLIIVLGVILTKDNCAPEEVIWEALSVMGVYVGKEHMFYGEPRKLLTQDWVQENYLEYRQVPGSDPAHYEFLWGSKAHAETSYEKVINYLVMLNAREPICYPSLYEEVLGEEQEGV

SEQ ID NO: 50091 - protein, 114 aa, Homo sapiens
  Payload ID: 10005
  Gene Symbol: MAGEA9B
  Gene Name: melanoma antigen family A9B
  ENSP ID: ENSP00000469924
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAE

SEQ ID NO: 50092 - protein, 97 aa, Homo sapiens
  Payload ID: 10005
  Gene Symbol: MAGEA9B
  Gene Name: melanoma antigen family A9B
  ENSP ID: ENSP00000470594
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDP

SEQ ID NO: 50093 - protein, 315 aa, Homo sapiens; identical to SEQ ID NO: 50090
  Payload ID: 10005
  Gene Symbol: MAGEA9B
  Gene Name: melanoma antigen family A9B
  Uniprot ID: P43362
  ENSP ID: ENSP00000471017

SEQ ID NO: 50094 - protein, 195 aa, Homo sapiens
  Payload ID: 10005
  Gene Symbol: MAGEA9B
  Gene Name: melanoma antigen family A9B
  ENSP ID: ENSP00000472733
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSM

SEQ ID NO: 50095 - protein, 347 aa, Homo sapiens
  Payload ID: 10006
  Gene Symbol: MAGEB1
  Gene Name: melanoma antigen family B1
  Uniprot ID: P43366
  ENSP ID: ENSP00000368264
MPRGQKSKLRAREKRRKAREETQGLKVAHATAAEKEECPSSSPVLGDTPTSSPAAGIPQKPQGAPPTTTAAAAVSCTESDEGAKCQGEENASFSQATTSTESSVKDPVAWEAGMLMHFILRKYKMREPIMKADMLKVVDEKYKDHFTEILNGASRRLELVFGLDLKEDNPSGHTYTLVSKLNLTNDGNLSNDWDFPRNGLLMPLLGVIFLKGNSATEEEIWKFMNVLGAYDGEEHLIYGEPRKFITQDLVQEKYLKYEQVPNSDPPRYQFLWGPRAYAETTKMKVLEFLAKMNGATPRDFPSHYEEALRDEEERAQVRSSVRARRRTTATTFRARSRAPFSRSSHPM

SEQ ID NO: 50096 - protein, 347 aa, Homo sapiens; identical to SEQ ID NO: 50095
  Payload ID: 10006
  Gene Symbol: MAGEB1
  Gene Name: melanoma antigen family B1
  Uniprot ID: P43366
  ENSP ID: ENSP00000380681

SEQ ID NO: 50097 - protein, 347 aa, Homo sapiens; identical to SEQ ID NO: 50095
  Payload ID: 10006
  Gene Symbol: MAGEB1
  Gene Name: melanoma antigen family B1
  Uniprot ID: P43366
  ENSP ID: ENSP00000380683

SEQ ID NO: 50098 - protein, 347 aa, Homo sapiens
  Payload ID: 10007
  Gene Symbol: MAGEB10
  Gene Name: melanoma antigen family B10
  Uniprot ID: Q96LZ2
  ENSP ID: ENSP00000368304
MPRGQKSKLRAREKRRQARGGLEDLIDALDILEEEEESPPSASACLKDVFQSSLDGASNNPHGLREAQSTSTSATAASHTRHPEGVNDQMEERPICTQDLEATDSFPRGPVDEKVIILVHYLLYKYQMKEPITKADMLRNVTQMSKSQFPVILSRASEHLELIFGLDLKEVEPNKHIYVLVNKLDLGCDAKLSDETGVPKTGLLMTVLGIIFTNGNCVAEEEVWKVFNTMGLYDGIEHFMFGEPRKLLTKDLVKENYLEYQQVPNSDPPRYQFLWGPRAHAETSKMKVLEFLAKVNDTAPSEFSNWYTEALQDEEERARARVAAKARVSATAGARSKVKSSKSSQLQ

SEQ ID NO: 50099 - protein, 347 aa, Homo sapiens; identical to SEQ ID NO: 50098
  Payload ID: 10007
  Gene Symbol: MAGEB10
  Gene Name: melanoma antigen family B10
  Uniprot ID: Q96LZ2
  ENSP ID: ENSP00000480889

SEQ ID NO: 50100 - protein, 324 aa, Homo sapiens
  Payload ID: 10008
  Gene Symbol: MAGEB16
  Gene Name: melanoma antigen family B16
  Uniprot ID: A2A368
  ENSP ID: ENSP00000382867
MSQDQESPRCTHDQHLQTFSETQSLEVAQVSKALEKTLLSSSHPLVPGKLKEAPAAKAESPLEVPQSFCSSSIAVTTTSSSESDEASSNQEEEDSPSSSEDTSDPRNVPADALDQKVAFLVNFMLHKCQMKKPITKADMLKIIIKDDESHFSEILLRASEHLEMIFGLDVVEVDPTTHCYGLFIKLGLTYDGMLSGEKGVPKTGLLIIVLGVIFMKGNRATEEEVWEVLNLTGVYSGKKHFIFGEPRMLITKDFVKEKYLEYQQVANSDPARYEFLWGPRAKAETSKMKVLEFVAKVHGSYPHSFPSQYAEALKEEEERARARI

SEQ ID NO: 50101 - protein, 324 aa, Homo sapiens; identical to SEQ ID NO: 50100
  Payload ID: 10008
  Gene Symbol: MAGEB16
  Gene Name: melanoma antigen family B16
  Uniprot ID: A2A368
  ENSP ID: ENSP00000382869

SEQ ID NO: 50102 - protein, 324 aa, Homo sapiens; identical to SEQ ID NO: 50100
  Payload ID: 10008
  Gene Symbol: MAGEB16
  Gene Name: melanoma antigen family B16
  Uniprot ID: A2A368
  ENSP ID: ENSP00000382870

SEQ ID NO: 50103 - protein, 324 aa, Homo sapiens; identical to SEQ ID NO: 50100
  Payload ID: 10008
  Gene Symbol: MAGEB16
  Gene Name: melanoma antigen family B16
  Uniprot ID: A2A368
  ENSP ID: ENSP00000382871

SEQ ID NO: 50104 - protein, 356 aa, Homo sapiens
  Payload ID: 10008
  Gene Symbol: MAGEB16
  Gene Name: melanoma antigen family B16
  ENSP ID: ENSP00000382874
MGTEAQPVVKAVILHCLPSCPHSCLLPPTRVIMSQDQESPRCTHDQHLQTFSETQSLEVAQVSKALEKTLLSSSHPLVPGKLKEAPAAKAESPLEVPQSFCSSSIAVTTTSSSESDEASSNQEEEDSPSSSEDTSDPRNVPADALDQKVAFLVNFMLHKCQMKKPITKADMLKIIIKDDESHFSEILLRASEHLEMIFGLDVVEVDPTTHCYGLFIKLGLTYDGMLSGEKGVPKTGLLIIVLGVIFMKGNRATEEEVWEVLNLTGVYSGKKHFIFGEPRMLITKDFVKEKYLEYQQVANSDPARYEFLWGPRAKAETSKMKVLEFVAKVHGSYPHSFPSQYAEALKEEEERARARI

SEQ ID NO: 50105 - protein, 336 aa, Homo sapiens
  Payload ID: 10009
  Gene Symbol: MAGEB17
  Gene Name: melanoma antigen family B17
  Uniprot ID: A8MXT2
  ENSP ID: ENSP00000382883
MPRGQASKRRAREKRRQARGEDQCLGGAQATAAEKEKLPSSSSPACQSPPQSFPNAGIPQESQRASYPSSPASAVSLTSSDEGAKGQKGESPNSFHGPSSSESTGRDLLNTKTGELVQFLLNKYIRKEPITREAMLKVINRKYKQHFPEILRRSTENVEVVFGLYLKEMDPSRQSYVLVGKLDFPNQGSLSDGGGFPLSGLLMVLLSTIFMHGNRATEEEMWECLNALGMYKGRKHFIYGEPQELVTKDLVREGYLEYQQVPSSDPPRYEFLWGPRARAETSKMKVLEFVAKLNDTVASTYKSRYEEALREEEEQARARAVARDSARARASRSFQP

SEQ ID NO: 50106 - protein, 336 aa, Homo sapiens; identical to SEQ ID NO: 50105
  Payload ID: 10009
  Gene Symbol: MAGEB17
  Gene Name: melanoma antigen family B17
  Uniprot ID: A8MXT2
  ENSP ID: ENSP00000382884

SEQ ID NO: 50107 - protein, 343 aa, Homo sapiens
  Payload ID: 10010
  Gene Symbol: MAGEB18
  Gene Name: melanoma antigen family B18
  Uniprot ID: Q96M61
  ENSP ID: ENSP00000314543
MPRGQKSKLRAREKRHQARCENQDLGATQATVAEGESPSPAYLLFGDRPQNLPAAETPSIPEALQGAPSTTNAIAPVSCSSNEGASSQDEKSLGSSREAEGWKEDPLNKKVVSLVHFLLQKYETKEPITKGDMIKFVIRKDKCHFNEILKRASEHMELALGVDLKEVDPIRHYYAFFSKLDLTYDETTSDEEKIPKTGLLMIALGVIFLNGNRAPEEAVWEIMNMMGVYADRKHFLYGDPRKVMTKDLVQLKYLEYQQVPNSDPPRYEFLWGPRAHAETSKMKVLEFVAKIHDTVPSAFPSCYEEALRDEEQRTQARAAARAHTAAMANARSRTTSSSFSHAK

SEQ ID NO: 50108 - protein, 319 aa, Homo sapiens
  Payload ID: 10011
  Gene Symbol: MAGEB2
  Gene Name: melanoma antigen family B2
  Uniprot ID: O15479
  ENSP ID: ENSP00000368273
MPRGQKSKLRAREKRRKARDETRGLNVPQVTEAEEEEAPCCSSSVSGGAASSSPAAGIPQEPQRAPTTAAAAAAGVSSTKSKKGAKSHQGEKNASSSQASTSTKSPSEDPLTRKSGSLVQFLLYKYKIKKSVTKGEMLKIVGKRFREHFPEILKKASEGLSVVFGLELNKVNPNGHTYTFIDKVDLTDEESLLSSWDFPRRKLLMPLLGVIFLNGNSATEEEIWEFLNMLGVYDGEEHSVFGEPWKLITKDLVQEKYLEYKQVPSSDPPRFQFLWGPRAYAETSKMKVLEFLAKVNGTTPCAFPTHYEEALKDEEKAGV

SEQ ID NO: 50109 - protein, 346 aa, Homo sapiens
  Payload ID: 10012
  Gene Symbol: MAGEB3
  Gene Name: melanoma antigen family B3
  Uniprot ID: O15480
  ENSP ID: ENSP00000355198
MPRGQKSTLHAREKRQQTRGQTQDHQGAQITATNKKKVSFSSPLILGATIQKKSAGRSRSALKKPQRALSTTTSVDVSYKKSYKGANSKIEKKQSFSQGLSSTVQSRTDPLIMKTNMLVQFLMEMYKMKKPIMKADMLKIVQKSHKNCFPEILKKASFNMEVVFGVDLKKVDSTKDSYVLVSKMDLPNNGTVTRGRGFPKTGLLLNLLGVIFMKGNCATEEKIWEFLNKMRIYDGKKHFIFGEPRKLITQDLVKLKYLEYRQVPNSNPARYEFLWGPRAHAETSKMKVLEFWAKVNKTVPSAFQFWYEEALRDEEERVQAAAMLNDGSSAMGRKCSKAKASSSSHA

SEQ ID NO: 50110 - protein, 346 aa, Homo sapiens; identical to SEQ ID NO: 50109
  Payload ID: 10012
  Gene Symbol: MAGEB3
  Gene Name: melanoma antigen family B3
  Uniprot ID: O15480
  ENSP ID: ENSP00000478513

SEQ ID NO: 50111 - protein, 346 aa, Homo sapiens
  Payload ID: 10013
  Gene Symbol: MAGEB4
  Gene Name: melanoma antigen family B4
  Uniprot ID: O15481
  ENSP ID: ENSP00000368266
MPRGQKSKLRAREKRQRTRGQTQDLKVGQPTAAEKEESPSSSSSVLRDTASSSLAFGIPQEPQREPPTTSAAAAMSCTGSDKGDESQDEENASSSQASTSTERSLKDSLTRKTKMLVQFLLYKYKMKEPTTKAEMLKIISKKYKEHFPEIFRKVSQRTELVFGLALKEVNPTTHSYILVSMLGPNDGNQSSAWTLPRNGLLMPLLSVIFLNGNCAREEEIWEFLNMLGIYDGKRHLIFGEPRKLITQDLVQEKYLEYQQVPNSDPPRYQFLWGPRAHAETSKMKVLEFLAKVNDTTPNNFPLLYEEALRDEEERAGARPRVAARRGTTAMTSAYSRATSSSSSQPM

SEQ ID NO: 50112 - protein, 275 aa, Homo sapiens
  Payload ID: 10014
  Gene Symbol: MAGEB5
  Gene Name: melanoma antigen family B5
  Uniprot ID: Q9BZ81
  ENSP ID: ENSP00000473493
MTSAGVFNAGSDERANSRDEEYPCSSEVSPSTESSCSNFINIKVGLLEQFLLYKFKMKQRILKEDMLKIVNPRYQNQFAEIHRRASEHIEVVFAVDLKEVNPTCHLYDLVSKLKLPNNGRIHVGKVLPKTGLLMTFLVVIFLKGNCANKEDTWKFLDMMQIYDGKKYYIYGEPRKLITQDFVRLTYLEYHQVPCSYPAHYQFLWGPRAYTETSKMKVLEYLAKVNDIAPGAFSSQYEEALQDEEESPSQRCSRNWHYCSGQDCLRAKFSSFSQPY

SEQ ID NO: 50113 - protein, 407 aa, Homo sapiens
  Payload ID: 10015
  Gene Symbol: MAGEB6
  Gene Name: melanoma antigen family B6
  Uniprot ID: Q8N7X4
  ENSP ID: ENSP00000368320
MPRGHKSKLRTCEKRQETNGQPQGLTGPQATAEKQEESHSSSSSSRACLGDCRRSSDASIPQESQGVSPTGSPDAVVSYSKSDVAANGQDEKSPSTSRDASVPQESQGASPTGSPDAGVSGSKYDVAANGQDEKSPSTSHDVSVPQESQGASPTGSPDAGVSGSKYDVAAEGEDEESVSASQKAIIFKRLSKDAVKKKACTLAQFLQKKFEKKESILKADMLKCVRREYKPYFPQILNRTSQHLVVAFGVELKEMDSSGESYTLVSKLGLPSEGILSGDNALPKSGLLMSLLVVIFMNGNCATEEEVWEFLGLLGIYDGILHSIYGDARKIITEDLVQDKYVVYRQVCNSDPPCYEFLWGPRAYAETTKMRVLRVLADSSNTSPGLYPHLYEDALIDEVERALRLRA

SEQ ID NO: 50114 - protein, 407 aa, Homo sapiens
  Payload ID: 10016
  Gene Symbol: MAGEB6P1
  Gene Name: melanoma antigen family B6 pseudogene 1
  ENSP ID: ENSP00000488257
MPRGQKSKLRARGKRRETHDQPQGLTGPQATAEKQEESRSSSSSSAVCQGARRRSSGSSVPQESQGASPTGYPDAGASCSKYDVAAMGQDEKSPSTSRDASVSQESQGASPIGPPDAGISCSKSDEAAKGQNEKSPSTSRDASVPQESQGASPTGSPDADVSGSKSDVAAKGQDEESLSSSKRAAFFTTTDGDPIKRKANKMVQFLQKKFEKKEPILKADMLKRLRRQYKPCFPEILKRTSEHLTVFFGVELKETDSSGESYTLVSKLGLSNEGSLSGDNALPKSGLLMSILGLIFMRGNRATEEEVWKFLGLLGIYDGILHSIYGDARKIITEDLVQDKYVVYRQVCNSDPPCYEFLWGPRAYAETTKMRVLRVLAEINNTSPGLYPHLYEDALTDEVERALRLRA

SEQ ID NO: 50115 - protein, 1142 aa, Homo sapiens
  Payload ID: 10017
  Gene Symbol: MAGEC1
  Gene Name: melanoma antigen family C1
  Uniprot ID: O60732
  ENSP ID: ENSP00000285879
MGDKDMPTAGMPSLLQSSSESPQSCPEGEDSQSPLQIPQSSPESDDTLYPLQSPQSRSEGEDSSDPLQRPPEGKDSQSPLQIPQSSPEGDDTQSPLQNSQSSPEGKDSLSPLEISQSPPEGEDVQSPLQNPASSFFSSALLSIFQSSPESTQSPFEGFPQSVLQIPVSAASSSTLVSIFQSSPESTQSPFEGFPQSPLQIPVSRSFSSTLLSIFQSSPERTQSTFEGFAQSPLQIPVSPSSSSTLLSLFQSFSERTQSTFEGFAQSSLQIPVSPSFSSTLVSLFQSSPERTQSTFEGFPQSPLQIPVSSSSSSTLLSLFQSSPERTHSTFEGFPQSLLQIPMTSSFSSTLLSIFQSSPESAQSTFEGFPQSPLQIPGSPSFSSTLLSLFQSSPERTHSTFEGFPQSPLQIPMTSSFSSTLLSILQSSPESAQSAFEGFPQSPLQIPVSSSFSYTLLSLFQSSPERTHSTFEGFPQSPLQIPVSSSSSSSTLLSLFQSSPECTQSTFEGFPQSPLQIPQSPPEGENTHSPLQIVPSLPEWEDSLSPHYFPQSPPQGEDSLSPHYFPQSPPQGEDSLSPHYFPQSPQGEDSLSPHYFPQSPPQGEDSMSPLYFPQSPLQGEEFQSSLQSPVSICSSSTPSSLPQSFPESSQSPPEGPVQSPLHSPQSPPEGMHSQSPLQSPESAPEGEDSLSPLQIPQSPLEGEDSLSSLHFPQSPPEWEDSLSPLHFPQFPPQGEDFQSSLQSPVSICSSSTSLSLPQSFPESPQSPPEGPAQSPLQRPVSSFFSYTLASLLQSSHESPQSPPEGPAQSPLQSPVSSFPSSTSSSLSQSSPVSSFPSSTSSSLSKSSPESPLQSPVISFSSSTSLSPFSEESSSPVDEYTSSSDTLLESDSLTDSESLIESEPLFTYTLDEKVDELARFLLLKYQVKQPITKAEMLTNVISRYTGYFPVIFRKAREFIEILFGISLREVDPDDSYVFVNTLDLTSEGCLSDEQGMSQNRLLILILSIIFIKGTYASEEVIWDVLSGIGVRAGREHFAFGEPRELLTKVWVQEHYLEYREVPNSSPPRYEFLWGPRAHSEVIKRKVVEFLAMLKNTVPITFPSSYKDALKDVEERAQAIIDTTDDSTATESASSSVMSPSFSSE

SEQ ID NO: 50116 - protein, 209 aa, Homo sapiens
  Payload ID: 10017
  Gene Symbol: MAGEC1
  Gene Name: melanoma antigen family C1
  Uniprot ID: O60732
  ENSP ID: ENSP00000385500
MLTNVISRYTGYFPVIFRKAREFIEILFGISLREVDPDDSYVFVNTLDLTSEGCLSDEQGMSQNRLLILILSIIFIKGTYASEEVIWDVLSGIGVRAGREHFAFGEPRELLTKVWVQEHYLEYREVPNSSPPRYEFLWGPRAHSEVIKRKVVEFLAMLKNTVPITFPSSYKDALKDVEERAQAIIDTTDDSTATESASSSVMSPSFSSE

SEQ ID NO: 50117 - protein, 373 aa, Homo sapiens
  Payload ID: 10018
  Gene Symbol: MAGEC2
  Gene Name: melanoma antigen family C2
  Uniprot ID: Q9UBF1
  ENSP ID: ENSP00000354660
MPPVPGVPFRNVDNDSPTSVELEDWVDAQHPTDEEEEEASSASSTLYLVFSPSSFSTSSSLILGGPEEEEVPSGVIPNLTESIPSSPPQGPPQGPSQSPLSSCCSSFSWSSFSEESSSQKGEDTGTCQGLPDSESSFTYTLDEKVAELVEFLLLKYEAEEPVTEAEMLMIVIKYKDYFPVILKRAREFMELLFGLALIEVGPDHFCVFANTVGLTDEGSDDEGMPENSLLIIILSVIFIKGNCASEEVIWEVLNAVGVYAGREHFVYGEPRELLTKVWVQGHYLEYREVPHSSPPYYEFLWGPRAHSESIKKKVLEFLAKLNNTVPSSFPSWYKDALKDVEERVQATIDTADDATVMASESLSVMSSNVSFSE

SEQ ID NO: 50118 - protein, 643 aa, Homo sapiens
  Payload ID: 10019
  Gene Symbol: MAGEC3
  Gene Name: melanoma antigen family C3
  Uniprot ID: Q8TD91
  ENSP ID: ENSP00000298296
MLLPCHWVLDATFSDGSLGQWVKNTCATYALSPVVLPPQPQPRKKATDKDYSAFHLGHLREVRLFLRGGTSDQRMDSLVLCPTYFKLWRTLSGSPGLQLSDLHFGSQPEGKFSLRRAVSVKQREEPQDWPLNEKRTLWKDSDLPTWRRGTGYTLSLPAVSPGKRLWGEKAGSLPESEPLFTYTLDEKVDKLVQFLLLKYQAKEPLTRAEMQMNVINTYTGYFPMIFRKAREFIEILFGISLTEVDPDHFYVFVNTLDLTCEGSLSDEQGMPQNRLLILILSVIFIKGNCASEEVIWEVLNAIGPWSALAGFADVLSRLALWESEGPEAFCEESGLRSAEGSVLDLANPQGLAGHRQEDGRRGLTEASPQQKKGGEDEDMPAAGMPPLPQSPPEIPPQGPPKISPQGPPQSPPQSPLDSCSSPLLWTRLDEESSSEEEDTATWHALPESESLPRYALDEKVAELVQFLLLKYQTKEPVTKAEMLTTVIKKYKDYFPMIFGKAHEFIELIFGIALTDMDPDNHSYFFEDTLDLTYEGSLIDDQGMPKNCLLILILSMIFIKGSCVPEEVIWEVLSAIGPIQRPAREVLEFLSKLSSIIPSAFPSWYMDALKDMEDRAQAIIDTTDDATAMASASPSVMSTNFCPE

SEQ ID NO: 50119 - protein, 346 aa, Homo sapiens
  Payload ID: 10019
  Gene Symbol: MAGEC3
  Gene Name: melanoma antigen family C3
  Uniprot ID: Q8TD91
  ENSP ID: ENSP00000386566
MPLFPNLPRLSFEEDFQNPSVTEDLVDAQDSIDEEEEDASSTSSSSFHFLFPSSSSLSSSSPLSSPLPSTLILGVPEDEDMPAAGMPPLPQSPPEIPPQGPPKISPQGPPQSPPQSPLDSCSSPLLWTRLDEESSSEEEDTATWHALPESESLPRYALDEKVAELVQFLLLKYQTKEPVTKAEMLTTVIKKYKDYFPMIFGKAHEFIELIFGIALTDMDPDNHSYFFEDTLDLTYEGSLIDDQGMPKNCLLILILSMIFIKGSCVPEEVIWEVLSAIGVCAGREHFIYGDPRKLLTIHWVQRKYLEYREVPNSAPPRYEFLWGPRAHSEASKRSLRVFIQAIQYHP

SEQ ID NO: 50120 - protein, 266 aa, Homo sapiens
  Payload ID: 10019
  Gene Symbol: MAGEC3
  Gene Name: melanoma antigen family C3
  ENSP ID: ENSP00000438254
MPAAGMPPLPQSPPEIPPQGPPKISPQGPPQSPPQSPLDSCSSPLLWTRLDEESSSEEEDTATWHALPESESLPRYALDEKVAELVQFLLLKYQTKEPVTKAEMLTTVIKKYKDYFPMIFGKAHEFIELIFGIALTDMDPDNHSYFFEDTLDLTYEGSLIDDQGMPKNCLLILILSMIFIKGSCVPEEVIWEVLSAIGVCAGREHFIYGDPRKLLTIHWVQRKYLEYREVPNSAPPRYEFLWGPRAHSEASKRSLRVFIQAIQYHP

SEQ ID NO: 50121 - protein, 346 aa, Homo sapiens; identical to SEQ ID NO: 50119
  Payload ID: 10019
  Gene Symbol: MAGEC3
  Gene Name: melanoma antigen family C3
  Uniprot ID: Q8TD91
  ENSP ID: ENSP00000440444

SEQ ID NO: 50122 - protein, 778 aa, Homo sapiens
  Payload ID: 10020
  Gene Symbol: MAGED1
  Gene Name: melanoma antigen family D1
  Uniprot ID: Q9Y5V3
  ENSP ID: ENSP00000325333
MAQKMDCGAGLLGFQAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 50123 - protein, 834 aa, Homo sapiens
  Payload ID: 10020
  Gene Symbol: MAGED1
  Gene Name: melanoma antigen family D1
  Uniprot ID: Q9Y5V3
  ENSP ID: ENSP00000364847
MAQKMDCGAGLLGFQNPDACRAVCHPLPQPPASTLPLSAFPTLCDPPYSQLRDPPAVLSCYCTPLGASPAPAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 50124 - protein, 778 aa, Homo sapiens; identical to SEQ ID NO: 50122
  Payload ID: 10020
  Gene Symbol: MAGED1
  Gene Name: melanoma antigen family D1
  Uniprot ID: Q9Y5V3
  ENSP ID: ENSP00000364874

SEQ ID NO: 50125 - protein, 778 aa, Homo sapiens; identical to SEQ ID NO: 50122
  Payload ID: 10020
  Gene Symbol: MAGED1
  Gene Name: melanoma antigen family D1
  Uniprot ID: Q9Y5V3
  ENSP ID: ENSP00000364927

SEQ ID NO: 50126 - protein, 606 aa, Homo sapiens
  Payload ID: 10021
  Gene Symbol: MAGED2
  Gene Name: melanoma antigen family D2
  Uniprot ID: Q9UNF1
  ENSP ID: ENSP00000218439
MSDTSESGAGLTRFQAEASEKDSSSMMQTLLTVTQNVEVPETPKASKALEVSEDVKVSKASGVSKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKALMASMARRASRGPIAFWARRASRTRLAAWARRALLSLRSPKARRGKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 50127 - protein, 588 aa, Homo sapiens
  Payload ID: 10021
  Gene Symbol: MAGED2
  Gene Name: melanoma antigen family D2
  ENSP ID: ENSP00000336962
MSDTSESGAGLTRFQAEASEKDSSSMMQTLLTVTQNVEVPETPKASKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKALMASMARRASRGPIAFWARRASRTRLAAWARRALLSLRSPKARRGKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 50128 - protein, 606 aa, Homo sapiens; identical to SEQ ID NO: 50126
  Payload ID: 10021
  Gene Symbol: MAGED2
  Gene Name: melanoma antigen family D2
  Uniprot ID: Q9UNF1
  ENSP ID: ENSP00000364193

SEQ ID NO: 50129 - protein, 606 aa, Homo sapiens; identical to SEQ ID NO: 50126
  Payload ID: 10021
  Gene Symbol: MAGED2
  Gene Name: melanoma antigen family D2
  Uniprot ID: Q9UNF1
  ENSP ID: ENSP00000364198

SEQ ID NO: 50130 - protein, 521 aa, Homo sapiens
  Payload ID: 10021
  Gene Symbol: MAGED2
  Gene Name: melanoma antigen family D2
  ENSP ID: ENSP00000364200
MSDTSESGAGLTRFQAEASEKDSSSMMQTLLTVTQNVEVPETPKASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 50131 - protein, 606 aa, Homo sapiens; identical to SEQ ID NO: 50126
  Payload ID: 10021
  Gene Symbol: MAGED2
  Gene Name: melanoma antigen family D2
  Uniprot ID: Q9UNF1
  ENSP ID: ENSP00000364209

SEQ ID NO: 50132 - protein, 606 aa, Homo sapiens; identical to SEQ ID NO: 50126
  Payload ID: 10021
  Gene Symbol: MAGED2
  Gene Name: melanoma antigen family D2
  Uniprot ID: Q9UNF1
  ENSP ID: ENSP00000379526

SEQ ID NO: 50133 - protein, 521 aa, Homo sapiens; identical to SEQ ID NO: 50130
  Payload ID: 10021
  Gene Symbol: MAGED2
  Gene Name: melanoma antigen family D2
  ENSP ID: ENSP00000486563

SEQ ID NO: 50134 - protein, 739 aa, Homo sapiens
  Payload ID: 10022
  Gene Symbol: MAGED4
  Gene Name: melanoma antigen family D4
  Uniprot ID: Q96JG8
  ENSP ID: ENSP00000364777
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQ

SEQ ID NO: 50135 - protein, 757 aa, Homo sapiens
  Payload ID: 10022
  Gene Symbol: MAGED4
  Gene Name: melanoma antigen family D4
  Uniprot ID: Q96JG8
  ENSP ID: ENSP00000472118
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKNPELREETPLSMAPSWYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQHR

SEQ ID NO: 50136 - protein, 741 aa, Homo sapiens
  Payload ID: 10023
  Gene Symbol: MAGED4B
  Gene Name: melanoma antigen family D4B
  Uniprot ID: Q96JG8
  ENSP ID: ENSP00000335385
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQHR

SEQ ID NO: 50137 - protein, 739 aa, Homo sapiens; identical to SEQ ID NO: 50134
  Payload ID: 10023
  Gene Symbol: MAGED4B
  Gene Name: melanoma antigen family D4B
  Uniprot ID: Q96JG8
  ENSP ID: ENSP00000353252

SEQ ID NO: 50138 - protein, 757 aa, Homo sapiens; identical to SEQ ID NO: 50135
  Payload ID: 10023
  Gene Symbol: MAGED4B
  Gene Name: melanoma antigen family D4B
  Uniprot ID: Q96JG8
  ENSP ID: ENSP00000421861

SEQ ID NO: 50139 - protein, 48 aa, Homo sapiens
  Payload ID: 10023
  Gene Symbol: MAGED4B
  Gene Name: melanoma antigen family D4B
  ENSP ID: ENSP00000422633
VSLPCPHPFSEAGRRGLSAAHRSHTQRGLPGDCWMKGMIAWEPRTLPG

SEQ ID NO: 50140 - protein, 33 aa, Homo sapiens
  Payload ID: 10023
  Gene Symbol: MAGED4B
  Gene Name: melanoma antigen family D4B
  ENSP ID: ENSP00000422913
  MOD_RES (1)..(1): Any amino acid
XVLWEALRKMGLRPGYDWPLQLLPSVLSSGQRG

SEQ ID NO: 50141 - protein, 741 aa, Homo sapiens; identical to SEQ ID NO: 50136
  Payload ID: 10023
  Gene Symbol: MAGED4B
  Gene Name: melanoma antigen family D4B
  Uniprot ID: Q96JG8
  ENSP ID: ENSP00000423848

SEQ ID NO: 50142 - protein, 271 aa, Homo sapiens
  Payload ID: 10023
  Gene Symbol: MAGED4B
  Gene Name: melanoma antigen family D4B
  ENSP ID: ENSP00000423971
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTR

SEQ ID NO: 50143 - protein, 957 aa, Homo sapiens
  Payload ID: 10024
  Gene Symbol: MAGEE1
  Gene Name: melanoma antigen family E1
  Uniprot ID: Q9HCI5
  ENSP ID: ENSP00000354912
MSLVSQNSRRRRRRVAKATAHNSSWGEMQAPNAPGLPADVPGSDVPQGPSDSQILQGLCASEGPSTSVLPTSAEGPSTFVPPTISEASSASGQPTISEGPGTSVLPTPSEGLSTSGPPTISKGLCTSVTLAASEGRNTSRPPTSSEEPSTSVPPTASEVPSTSLPPTPGEGTSTSVPPTAYEGPSTSVVPTPDEGPSTSVLPTPGEGPGTSVPLAATEGLSTSVQATPDEGPSTSVPPTATEGLSTPVPPTRDEGPSTSVPATPGEGPSTSVLPAASDGQSISLVPTRGKGSSTSVPPTATEGLSTSVQPTAGEGSSTSVPPTPGGGLSTSVPPTATEELSTSVPPTPGEGPSTSVLPIPGEGLSTSVPPTASDGSDTSVPPTPGEGASTLVQPTAPDGPGSSVLPNPGEGPSTLFSSSASVDRNPSKCSLVLPSPRVTKASVDSDSEGPKGAEGPIEFEVLRDCESPNSISIMGLNTSRVAITLKPQDPMEQNVAELLQFLLVKDQSKYPIRESEMREYIVKEYRNQFPEILRRAAAHLECIFRFELRELDPEAHTYILLNKLGPVPFEGLEESPNGPKMGLLMMILGQIFLNGNQAKEAEIWEMLWRMGVQRERRLSIFGNPKRLLSVEFVWQRYLDYRPVTDCKPVEYEFFWGPRSHLETTKMKILKFMAKIYNKDPMDWPEKYNEALEEDAARAFAEGWQALPHFRRPFFEEAAAEVPSPDSEVSSYSSKYAPHSWPESRLESKARKLVQLFLLMDSTKLPIPKKGILYYIGRECSKVFPDLLNRAARTLNHVYGTELVVLDPRNHSYTLYNRREMEETEEIVDSPNRPGNNFLMQVLSFIFIMGNHARESAVWAFLRGLGVQAGRKHVITCRYLSQRYIDSLRVPDSDPVQYEFVWGPRARLETSKMKALRYVARIHRKEPQDWPQQYREAMEDEANRADVGHRQIFVHNFR

SEQ ID NO: 50144 - protein, 523 aa, Homo sapiens
  Payload ID: 10025
  Gene Symbol: MAGEE2
  Gene Name: melanoma antigen family E2
  Uniprot ID: Q8TD90
  ENSP ID: ENSP00000362457
MSLVSQNARHCSAEITADYGDGRGEIQATNASGSPTSMLVVDAPQCPQAPINSQCVNTSQAVQDPNDLEVLIDEQSRRLGALRVHDPLEDRSIALVNFMRMKSQTEGSIQQSEMLEFLREYSDQFPEILRRASAHLDQVFGLNLRVIDPQADTYNLVSKRGFQITDRIAESLDMPKASLLALVLGHILLNGNRAREASIWDLLLKVDMWDKPQRINNLFGNTRNLLTTDFVCMRFLEYWPVYGTNPLEFEFLWGSRAHREITKMEALKFVSDAHDEEPWSWPEEYNKALEGDKTKERSLTAGLEFWSEDTMNDKANDLVQLAISVTEEMLPIHQDELLAHTGKEFEDVFPNILNRATLILDMFYGLSLIEVDTSEHIYLLVQQPESEEEQVMLESLGRPTQEYVMPILGLIFLMGNRVKEANVWNLLRRFSVDVGRKHSITRKLMRQRYLECRPLSYSNPVEYELLWGPRAHHETIKMKVLEYMARLYRKRPQNWPEQYREAVEDEEARAKSEATIMFFLDPT

SEQ ID NO: 50145 - protein, 307 aa, Homo sapiens
  Payload ID: 10026
  Gene Symbol: MAGEF1
  Gene Name: melanoma antigen family F1
  Uniprot ID: Q9HAY2
  ENSP ID: ENSP00000315064
MLQTPESRGLPVPQAEGEKDGGHDGETRAPTASQERPKEELGAGREEGAAEPALTRKGARALAAKALARRRAYRRLNRTVAELVQFLLVKDKKKSPITRSEMVKYVIGDLKILFPDIIARAAEHLRYVFGFELKQFDRKHHTYILINKLKPLEEEEEEDLGGDGPRLGLLMMILGLIYMRGNSAREAQVWEMLRRLGVQPSKYHFLFGYPKRLIMEDFVQQRYLSYRRVPHTNPPEYEFSWGPRSNLEISKMEVLGFVAKLHKKEPQHWPVQYREALADEADRARAKARAEASMRARASARAGIHLW

SEQ ID NO: 50146 - protein, 219 aa, Homo sapiens
  Payload ID: 10027
  Gene Symbol: MAGEH1
  Gene Name: melanoma antigen family H1
  Uniprot ID: Q9H213
  ENSP ID: ENSP00000343706
MPRGRKSRRRRNARAAEENRNNRKIQASEASETPMAASVVASTPEDDLSGPEEDPSTPEEASTTPEEASSTAQAQKPSVPRSNFQGTKKSLLMSILALIFIMGNSAKEALVWKVLGKLGMQPGRQHSIFGDPKKIVTEEFVRRGYLIYKPVPRSSPVEYEFFWGPRAHVESSKLKVMHFVARVRNRCSKDWPCNYDWDSDDDAEVEAILNSGARGYSAP

SEQ ID NO: 50147 - protein, 1249 aa, Homo sapiens
  Payload ID: 10028
  Gene Symbol: MAGEL2
  Gene Name: melanoma antigen family L2
  Uniprot ID: Q9UJ55
  ENSP ID: ENSP00000433433
MSQLSKNLGDSSPPAEAPKPPVYSRPTVLMRAPPASSRAPPVPWDPPPIDLQASLAAWQAPQPAWEAPQGQLPAPVVPMTQPPALGGPIVPAPPLGGPMGKPPTPGVLMVHPPPPGAPMAQPPTPGVLMVHPSAPGAPMAHPPPPGTPMSHPPPPGTPMAHPPPPGTPMAHPPPPGTPMVHPPPPGTPMAHPPPPGTPMAHPPPPGTPMAHPPPPGTPMAHPPPPGTPMAQPPAPGVLMAQPLTPGVLMVQPAAPGAPMVQPPPAAMMTQPQPSGAPMAKPPGPGVLMIHPPGARAPMTQPPASGAPMAQPAAPPAQPMAPPAQPMASWAPQAQPLILQIQSQVIRAPPQVPQGPQAPPAQLATPPGWQATSPGWQATQQGWQATPLTWQTTQVTWQAPAVTWQVPPPMRQGPPPIRPGPPPIRPGPPPVRQAPPLIRQAPPVIRQAPPVIRQAPPVIRQAPAVIRQAPPVIRQAPPVIRQAPPVIRQAPPLIRQAPPPIRPAPQVLATQPPLWQALPPPPPLRQAPQARLPAPQVQAAPQVPTAPPATQVPAAPPAGPQVPQPVLPAPLSAPLSAPQAVHCPSIIWQAPKGQPPVPHEIPTSMEFQEVQQTQALAWQAQKAPTHIWQPLPAQEAQRQAPPLVQLEQPFQGAPPSQKAVQIQLPPQQAQASGPQAEVPTLPLQPSWQAPPAVLQAQPGPPVAAANFPLGSAKSLMTPSGECRASSIDRRGSSKERRTSSKERRAPSKDRMIFAATFCAPKAVSAARAHLPAAWKNLPATPETFAPSSSVFPATSQFQPASLNAFKGPSAASETPKSLPYALQDPFACVEALPAVPWVPQPNMNASKASQAVPTFLMATAAAPQATATTQEASKTSVEPPRRSGKATRKKKHLEAQEDSRGHTLAFHDWQGPRPWENLNLSDWEVQSPIQVSGDWEHPNTPRGLSGWEGPSTSRILSGWEGPSASWALSAWEGPSTSRALGLSESPGSSLPVVVSEVASVSPGSSATQDNSKVEAQPLSPLDERANALVQFLLVKDQAKVPVQRSEMVKVILREYKDECLDIINRANNKLECAFGYQLKEIDTKNHAYIIINKLGYHTGNLVASYLDRPKFGLLMVVLSLIFMKGNCVREDLIFNFLFKLGLDVRETNGLFGNTKKLITEVFVRQKYLEYRRIPYTEPAEYEFLWGPRAFLETSKMLVLRFLAKLHKKDPQSWPFHYLEALAECEWEDTDEDEPDTGDSAHGPTSRPPPR

SEQ ID NO: 50148 - protein, 732 aa, Homo sapiens
  Payload ID: 10029
  Gene Symbol: MUM1
  Gene Name: melanoma associated antigen (mutated) 1
  Uniprot ID: Q2TAK8
  ENSP ID: ENSP00000394925
MMADAKYVLCRWEKRLWPAKVLARTATSTKNKRRKEYFLAVQILSLEEKIKVKSTEVEILEKSQIEAIASSLASQNEVPAAPLEELAYRRSLRVALDVLSEGSIWSQESSAGTGRADRSLRGKPMEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGGNSAQKASLCLNGSSLSEDDTERDMGSKGGSWAAPSLPSGVREDDPCANAEGHDPGLPLGSLTAPPAPEPSACSEPGECPAKKRPRLDGSQRPPAVQLEPMAAGAAPSPGPGPGPRESVTPRSTARLGPPPSHASADATRCLPCPDSQKLEKECQSSEESMGSNSMRSILEEDEEDEEPPRVLLYHEPRSFEVGMLVWHKHKKYPFWPAVVKSVRQRDKKASVLYIEGHMNPKMKGFTVSLKSLKHFDCKEKQTLLNQAREDFNQDIGWCVSLITDYRVRLGCGSFAGSFLEYYAADISYPVRKSIQQDVLGTKLPQLSKGSPEEPVVGCPLGQRQPCRKMLPDRSRAARDRANQKLVEYIVKAKGAESHLRAILKSRKPSRWLQTFLSSSQYVTCVETYLEDEGQLDLVVKYLQGVYQEVGAKVLQRTNGDRIRFILDVLLPECWEMRVRALDPVRRRSRLLDPCAEMELLRSCQHQGVRTPSLLRAHRCFPASVGHHLCDLCGGRGGLQDG

SEQ ID NO: 50149 - protein, 79 aa, Homo sapiens
  Payload ID: 10029
  Gene Symbol: MUM1
  Gene Name: melanoma associated antigen (mutated) 1
  ENSP ID: ENSP00000465838
MMADAKYVLCRWEKRLWPAKVLARTATSTKNKRRKEYFLAVQILSLEEKIKVKSTEVEILEKSQIEAIASSLGNANPLS

SEQ ID NO: 50150 - protein, 48 aa, Homo sapiens
  Payload ID: 10029
  Gene Symbol: MUM1
  Gene Name: melanoma associated antigen (mutated) 1
  ENSP ID: ENSP00000466891
MMADAKYVLCRWEKRLWPAKVLARTATSTKNKRRKEYFLAVQILSLEE

SEQ ID NO: 50151 - protein, 711 aa, Homo sapiens
  Payload ID: 10029
  Gene Symbol: MUM1
  Gene Name: melanoma associated antigen (mutated) 1
  ENSP ID: ENSP00000467083
MMADAKYVLCRWEKRLWPAKVLARTATSTKNKRRKEYFLAVQILSLEEKIKVKSTEVEILEKSQIEAIASSLASQNEVPAAPLEELAYRRSLRVALDVLSEGSIWSQESSAGTGRADRSLRGKPMEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGGNSAQKASLCLNGSSLSEDDTERDMGSKGGSWAAPSLPSGVREDDPCANAEGHDPGLPLGSLTAPPAPEPSACSEPGECPAKKRPRLDGSQRPPAVQLEPMAAGAAPSPGPGPGPRESVTPRSTARLGPPPSHASADATRCLPCPDSQKLEKECQSSEESMGSNSMRSILEEDEEDEEPPRVLLYHEPRSFEVGMLVWHKHKKYPFWPAVVKSVRQRDKKASVLYIEGHMNPKMKGFTVSLKSLKHFDCKEKQTLLNQAREDFNQDIGWCVSLITDYRVRLGCGSFAGSFLEYYAADISYPVRKSIQQDVLGTKLPQLSKGSPEEPVVGCPLGQRQPCRKMLPDRSRAARDRANQKLVEYIVKAKGAESHLRAILKSRKPSRWLQTFLSSSQYVTCVETYLEDEGQLDLVVKYLQGVYQEVGAKVLQRTNGDRIRFILDVLLPEAIICAISAVDEVDYKTAEEKYIKGPSLSYREKEIFDNQLLEERNRRRR

SEQ ID NO: 50152 - protein, 264 aa, Homo sapiens
  Payload ID: 10029
  Gene Symbol: MUM1
  Gene Name: melanoma associated antigen (mutated) 1
  ENSP ID: ENSP00000467287
MMADAKYVLCRWEKRLWPAKVLARTATSTKNKRRKEYFLAVQILSLEEKIKVKSTEVEILEKSQIEAIASSLASQNEVPAAPLEELAYRRSLRVALDVLSEGSIWSQESSAGTGRADRSLRGKPMEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGGNSAQKASLCLNGSSLSEDDTERDMGSKGGSWAAPSLPSGVREDD

SEQ ID NO: 50153 - protein, 79 aa, Homo sapiens; identical to SEQ ID NO: 50149
  Payload ID: 10029
  Gene Symbol: MUM1
  Gene Name: melanoma associated antigen (mutated) 1
  ENSP ID: ENSP00000468322

SEQ ID NO: 50154 - protein, 79 aa, Homo sapiens; identical to SEQ ID NO: 50149
  Payload ID: 10029
  Gene Symbol: MUM1
  Gene Name: melanoma associated antigen (mutated) 1
  ENSP ID: ENSP00000468557

SEQ ID NO: 50155 - protein, 711 aa, Homo sapiens; identical to SEQ ID NO: 50151
  Payload ID: 10029
  Gene Symbol: MUM1
  Gene Name: melanoma associated antigen (mutated) 1
  ENSP ID: ENSP00000486562

SEQ ID NO: 50156 - protein, 732 aa, Homo sapiens; identical to SEQ ID NO: 50148
  Payload ID: 10029
  Gene Symbol: MUM1
  Gene Name: melanoma associated antigen (mutated) 1
  ENSP ID: ENSP00000487567

SEQ ID NO: 50157 - protein, 696 aa, Homo sapiens
  Payload ID: 10030
  Gene Symbol: MUM1L1
  Gene Name: melanoma associated antigen (mutated) 1-like 1
  Uniprot ID: Q5H9M0
  ENSP ID: ENSP00000338641
MESEYVLCNWKDQLWPAKVLSRSETSSNSKRKKAFSLEVQILSLDEKIKLDSTETKILNKSQIEAIAASLGLQSEDSAPPTEETAYGRSLKVALGILNERTNLSQASTSDEEEITMLSQNVPQKQSDSPPHKKYRKDEGDLPGCLEERENSACLLASSESDDSLYDDKSQAPTMVDTIPSEVETKSLQNSSWCETFPSLSEDNDEKENKNKIDISAVMSVHSAVKEESACVKDEKFAPPLSPLSSDMLIMPKALKEESEDTCLETLAVPSECSAFSENIEDPGEGPSNPCLDTSQNQPSMESEMGAAACPGSCSRECEVSFSASNPVWDYSHLMSSERNFQRLDFEELEEEGQASDKSLLPSRINLSLLDDDEEDEELPRFILHYETHPFETGMIVWFKYQKYPFWPAVIKSIRRKERKASVLFVEANMNSEKKGIRVNFRRLKKFDCKEKQMLVDKAREDYSESIDWCISLICDYRVRIGCGSFTGSLLEYYAADISYPVRKETKQDTFRNKFPKLHNEDAREPMAVTSQTKKMSFQKILPDRMKAARDRANKNLVDFIVNAKGTENHLLAIVNGTKGSRWLKSFLNANRFTPCIETYFEDEDQLDEVVKYLQEVCNQIDQIMPTWIKDDKIKFILEVLLPEAIICSISAVDGLDYEAAEAKYLKGPCLGYRERELFDAKIIYEKRRKAPTNEAH

SEQ ID NO: 50158 - protein, 696 aa, Homo sapiens; identical to SEQ ID NO: 50157
  Payload ID: 10030
  Gene Symbol: MUM1L1
  Gene Name: melanoma associated antigen (mutated) 1-like 1
  Uniprot ID: Q5H9M0
  ENSP ID: ENSP00000349699

SEQ ID NO: 50159 - protein, 696 aa, Homo sapiens; identical to SEQ ID NO: 50157
  Payload ID: 10030
  Gene Symbol: MUM1L1
  Gene Name: melanoma associated antigen (mutated) 1-like 1
  Uniprot ID: Q5H9M0
  ENSP ID: ENSP00000361632

SEQ ID NO: 50160 - protein, 424 aa, Homo sapiens
  Payload ID: 10030
  Gene Symbol: MUM1L1
  Gene Name: melanoma associated antigen (mutated) 1-like 1
  ENSP ID: ENSP00000484745
MESEYVLCNWKDQLWPAKVLSRSETSSNSKRKKAFSLEVQILSLDEKIKLDSTETKILNKSQIEAIAASLGLQSEDSAPPTEETAYGRSLKVALGILNERTNLSQASTSDEEEITMLSQNVPQKQSDSPPHKKYRKDEGDLPGCLEERENSACLLASSESDDSLYDDKSQAPTMVDTIPSEVETKSLQNSSWCETFPSLSEDNDEKENKNKIDISAVMSVHSAVKEESACVKDEKFAPPLSPLSSDMLIMPKALKEESEDTCLETLAVPSECSAFSENIEDPGEGPSNPCLDTSQNQPSMESEMGAAACPGSCSRECEVSFSASNPVWDYSHLMSSERNFQRLDFEELEEEGQASDKSLLPSRINLSLLDDDEEDEELPRFILHYETHPFETGMIVWFKYQKYPFGSSDKKYQTKREESKCAFC

SEQ ID NO: 50161 - protein, 646 aa, Homo sapiens
  Payload ID: 10031
  Gene Symbol: MCAM
  Gene Name: melanoma cell adhesion molecule
  Uniprot ID: P43121
  ENSP ID: ENSP00000264036
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 50162 - protein, 131 aa, Homo sapiens
  Payload ID: 10032
  Gene Symbol: MIA
  Gene Name: melanoma inhibitory activity
  Uniprot ID: Q16674
  ENSP ID: ENSP00000263369
MARSLVCLGVIILLSAFSGPGVRGGPMPKLADRKLCADQECSHPISMAVALQDYMAPDCRFLTIHRGQVVYVFSKLKGRGRLFWGGSVQGDYYGDLAARLGYFPSSIVREDQTLKPGKVDVKTDKWDFYCQ

SEQ ID NO: 50163 - protein, 131 aa, Homo sapiens; identical to SEQ ID NO: 50162
  Payload ID: 10032
  Gene Symbol: MIA
  Gene Name: melanoma inhibitory activity
  Uniprot ID: Q16674
  ENSP ID: ENSP00000469499

SEQ ID NO: 50164 - protein, 131 aa, Homo sapiens; identical to SEQ ID NO: 50162
  Payload ID: 10032
  Gene Symbol: MIA
  Gene Name: melanoma inhibitory activity
  Uniprot ID: Q16674
  ENSP ID: ENSP00000470129

SEQ ID NO: 50165 - protein, 95 aa, Homo sapiens
  Payload ID: 10032
  Gene Symbol: MIA
  Gene Name: melanoma inhibitory activity
  ENSP ID: ENSP00000470641
  MOD_RES (1)..(1): Any amino acid
XRSLVCLGVIILLSAFSGPGVRGGPMPKLADRKLCADQECSHPISMAVALQDYMAPDCRFLTIHRGQVVFREITMEIWLLAWAISPVALSERTRP

SEQ ID NO: 50166 - protein, 58 aa, Homo sapiens
  Payload ID: 10032
  Gene Symbol: MIA
  Gene Name: melanoma inhibitory activity
  ENSP ID: ENSP00000471439
  MOD_RES (1)..(1): Any amino acid
XSLVCLGVIILLSAFSGPGVRGGPMPKLADRKLCADQECSRSGRLLWRSGCSPGLFPQ

SEQ ID NO: 50167 - protein, 45 aa, Homo sapiens
  Payload ID: 10032
  Gene Symbol: MIA
  Gene Name: melanoma inhibitory activity
  ENSP ID: ENSP00000472982
MARSLVCLGVIILLSAFSGPGVRGGPMPKLADRKLCADQECSHPI

SEQ ID NO: 50168 - protein, 654 aa, Homo sapiens
  Payload ID: 10033
  Gene Symbol: MIA2
  Gene Name: melanoma inhibitory activity 2
  Uniprot ID: Q96PC5
  ENSP ID: ENSP00000280082
MAKFGVHRILLLAISLTKCLESTKLLADLKKCGDLECEALINRVSAMRDYRGPDCRYLNFTKGEEISVYVKLAGEREDLWAGSKGKEFGYFPRDAVQIEEVFISEEIQMSTKESDFLCLLGVSYTFDNEDSELNGDYGENIYPYEEDKDEKSSIYESDFQIEPGFYATYESTLFEDQVPALEAPEDIGSTSESKDWEEVVVESMEQDRIPEVHVPPSSAVSGVKEWFGLGGEQAEEKAFESVIEPVQESSFRSRKIAVEDENDLEELNNGEPQTEHQQESESEIDSVPKTQSELASESEHIPKPQSTGWFGGGFTSYLGFGDEDTGLELIAEESNPPLQDFPNSISSDKEATVPCTEILTEKKDTITNDSLSLKPSWFDFGFAILGFAYAKEDKIMLDDRKNEEDGGADEHEHPLTSELDPEKEQEIETIKIIETEDQIDKKPVSEKTDESDTIPYLKKFLYNFDNPWNFQNIPKETELPFPKQILDQNNVIENEETGEFSIDNYPTDNTKVMIFKSSYSLSDMVSNIELPTRIHEEVYFEPSSSKDSDENSKPSVDTEGPALVEIDRSVENTLLNSQMVSTDNSLSSQNYISQKEDASEFQILKYLFQIDVYDFMNSAFSPIVILTERVSLPFKPFAIILPILLNIRVATKYV

SEQ ID NO: 50169 - protein, 92 aa, Homo sapiens
  Payload ID: 10033
  Gene Symbol: MIA2
  Gene Name: melanoma inhibitory activity 2
  ENSP ID: ENSP00000451883
MAKFGVHRILLLAISLTKCLESTKLLADLKKCGDLECEALINRVSAMRDYRGPDCRYLNFTKGEEISVYVKLAGEREDLWAGSKGKEFGYFP

SEQ ID NO: 50170 - protein, 1907 aa, Homo sapiens
  Payload ID: 10034
  Gene Symbol: MIA3
  Gene Name: melanoma inhibitory activity family, member 3
  Uniprot ID: Q5JRA6
  ENSP ID: ENSP00000340900
MAAAPGLLVWLLVLRLPWRVPGQLDPSTGRRFSEHKLCADDECSMLMYRGEALEDFTGPDCRFVNFKKGDPVYVYYKLARGWPEVWAGSVGRTFGYFPKDLIQVVHEYTKEELQVPTDETDFVCFDGGRDDFHNYNVEELLGFLELYNSAATDSEKAVEKTLQDMEKNPELSKEREPEPEPVEANSEESDSVFSENTEDLQEQFTTQKHHSHANSQANHAQGEQASFESFEEMLQDKLKVPESENNKTSNSSQVSNEQDKIDAYKLLKKEMTLDLKTKFGSTADALVSDDETTRLVTSLEDDFDEELDTEYYAVGKEDEENQEDFDELPLLTFTDGEDMKTPAKSGVEKYPTDKEQNSNEEDKVQLTVPPGIKNDDKNILTTWGDTIFSIVTGGEETRDTMDLESSSSEEEKEDDDDALVPDSKQGKPQSATDYSDPDNVDDGLFIVDIPKTNNDKEVNAEHHIKGKGRGVQESKRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHENTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 50171 - protein, 500 aa, Homo sapiens
  Payload ID: 10034
  Gene Symbol: MIA3
  Gene Name: melanoma inhibitory activity family, member 3
  Uniprot ID: Q5JRA6
  ENSP ID: ENSP00000341348
MAAAPGLLVWLLVLRLPWRVPGQLDPSTGRRFSEHKLCADDECSMLMYRGEALEDFTGPDCRFVNFKKGDPVYVYYKLARGWPEVWAGSVGRTFGYFPKDLIQVVHEYTKEELQVPTDETDFVCFDGGRDDFHNYNVEELLGFLELYNSAATDSEKAVEKTLQDMEKNPELSKEREPEPEPVEANSEESDSVFSENTEDLQEQFTTQKHHSHANSQANHAQGEQASFESFEEMLQDKLKVPESENNKTSNSSQVSNEQDKIDAYKLLKKEMTLDLKTKFGSTADALVSDDETTRLVTSLEDDFDEELDTEYYAVGKEDEENQEDFDELPLLTFTDGEDMKTPAKSGVEKYPTDKEQNSNEEDKVQLTVPPGIKNDDKNILTTWGDTIFSIVTGGEETRDTMDLESSSSEEEKEDDDDALVPDSKQGKPQSATDYSDPDNVDDGLFIVDIPKTNNDKEVNAEHHIKGKGRGVQESKRGLVQDKTELEDENQEGFKTEPIKL

SEQ ID NO: 50172 - protein, 785 aa, Homo sapiens
  Payload ID: 10034
  Gene Symbol: MIA3
  Gene Name: melanoma inhibitory activity family, member 3
  Uniprot ID: Q5JRA6
  ENSP ID: ENSP00000345866
MDSVPATVPSIAATPGDPELVGPLSVLYAAFIAKLLELVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 50173 - protein, 1015 aa, Homo sapiens
  Payload ID: 10034
  Gene Symbol: MIA3
  Gene Name: melanoma inhibitory activity family, member 3
  ENSP ID: ENSP00000355062
  MOD_RES (1)..(1): Any amino acid
XLVPDSKQGKPQSATDYSDPDNVDDGLFIVDIPKTNNDKEVNAEHHIKGKGRGVQESKRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHENTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQ

SEQ ID NO: 50174 - protein, 107 aa, Homo sapiens
  Payload ID: 10034
  Gene Symbol: MIA3
  Gene Name: melanoma inhibitory activity family, member 3
  ENSP ID: ENSP00000396598
  MOD_RES (1)..(1): Any amino acid
XSAEASGKPSPSDPGSGTATMMNSSSRGSSPTRVLDEGKVNMAPKGPPPFPGVPLMSTPMGGPVPPPIRYGPPPQLCGPFGPRPLPPPFDKDGRPGTVAHACNPSTL

SEQ ID NO: 50175 - protein, 600 aa, Homo sapiens
  Payload ID: 10035
  Gene Symbol: MLPH
  Gene Name: melanophilin
  Uniprot ID: Q9BV36
  ENSP ID: ENSP00000264605
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 50176 - protein, 572 aa, Homo sapiens
  Payload ID: 10035
  Gene Symbol: MLPH
  Gene Name: melanophilin
  Uniprot ID: Q9BV36
  ENSP ID: ENSP00000341845
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 50177 - protein, 457 aa, Homo sapiens
  Payload ID: 10035
  Gene Symbol: MLPH
  Gene Name: melanophilin
  Uniprot ID: Q9BV36
  ENSP ID: ENSP00000386338
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 50178 - protein, 480 aa, Homo sapiens
  Payload ID: 10035
  Gene Symbol: MLPH
  Gene Name: melanophilin
  Uniprot ID: Q9BV36
  ENSP ID: ENSP00000386780
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQGLGAGVRTEADVEEEALRRKLEELTSNVSDQETSSEEEEAKDEKAEPNRDKSVGPLPQADPEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 50179 - protein, 199 aa, Homo sapiens
  Payload ID: 10035
  Gene Symbol: MLPH
  Gene Name: melanophilin
  ENSP ID: ENSP00000393010
  MOD_RES (1)..(1): Any amino acid
XSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAMKEWPQPM

SEQ ID NO: 50180 - protein, 145 aa, Homo sapiens
  Payload ID: 10035
  Gene Symbol: MLPH
  Gene Name: melanophilin
  ENSP ID: ENSP00000399081
VQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFASPSQ

SEQ ID NO: 50181 - protein, 70 aa, Homo sapiens
  Payload ID: 10035
  Gene Symbol: MLPH
  Gene Name: melanophilin
  ENSP ID: ENSP00000403909
MGKKLDLSKLTDEEAQHVLEVVQRDFDLRRKEEERLEALKGKIKKESSKRELLSDTAHLNETHCARCLQP

SEQ ID NO: 50182 - protein, 203 aa, Homo sapiens
  Payload ID: 10035
  Gene Symbol: MLPH
  Gene Name: melanophilin
  ENSP ID: ENSP00000405337
  MOD_RES (1)..(1): Any amino acid
XRHGALAELCPPGGSHRMALGTAAALAFRFSLQVIQTHSRSEGSNVIRNEQLPLQYLADVDTSDEESIRAHVMASHHSKRRGRASSESQGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESE

SEQ ID NO: 50183 - protein, 131 aa, Homo sapiens
  Payload ID: 10035
  Gene Symbol: MLPH
  Gene Name: melanophilin
  ENSP ID: ENSP00000409170
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKR

SEQ ID NO: 50184 - protein, 236 aa, Homo sapiens
  Payload ID: 10035
  Gene Symbol: MLPH
  Gene Name: melanophilin
  ENSP ID: ENSP00000409897
  MOD_RES (1)..(1): Any amino acid
XSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 50185 - protein, 360 aa, Homo sapiens
  Payload ID: 10035
  Gene Symbol: MLPH
  Gene Name: melanophilin
  ENSP ID: ENSP00000412438
TSTSRETQMTPLSLKVTPCTCPQSLRPGTAHSPSQMSPAQRRQPLTRLRAWRRLILGPLGATPIRKSSRPASHLPDTAPWLSSARLEAPTGWPWGLLLHSIFELNKHISAVECLLTYLENTVVPPLAKGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 50186 - protein, 214 aa, Homo sapiens
  Payload ID: 10036
  Gene Symbol: MREG
  Gene Name: melanoregulin
  Uniprot ID: Q8N565
  ENSP ID: ENSP00000263268
MGLRDWLRTVCCCCGCECLEERALPEKEPLVSDNNPYSSFGATLVRDDEKNLWSMPHDVSHTEADDDRTLYNLIVIRNQQAKDSEEWQKLNYDIHTLRQVRREVRNRWKCILEDLGFQKEADSLLSVTKLSTISDSKNTRKAREMLLKLAEETNIFPTSWELSERYLFVVDRLIALDAAEEFFKLARRTYPKKPGVPCLADGQKELHYLPFPSP

SEQ ID NO: 50187 - protein, 115 aa, Homo sapiens
  Payload ID: 10036
  Gene Symbol: MREG
  Gene Name: melanoregulin
  ENSP ID: ENSP00000404470
MPHDVSHTEADDDRTLYNLIVIRNQQAKDSEEWQKLNYDIHTLRQVRREVRNRWKCILEDLGFQKEADSLLSVTKLSTISDSKNTRKAREMLLKLAEETNIFPTSWELSERYLFV

SEQ ID NO: 50188 - protein, 129 aa, Homo sapiens
  Payload ID: 10036
  Gene Symbol: MREG
  Gene Name: melanoregulin
  ENSP ID: ENSP00000411076
MPHDVSHTEADDDRTLYNLIVIRNQQAKDSEEWQKLNYDIHTLRQVRREVRNRWKCILEDLGFQKEADSLLSVTKLSTISDSKNTRKAREMLLKLAEETNIFPTSWELSERYLFVVDRLIALDAAEEFF

SEQ ID NO: 50189 - protein, 119 aa, Homo sapiens
  Payload ID: 10036
  Gene Symbol: MREG
  Gene Name: melanoregulin
  ENSP ID: ENSP00000413302
MPHDVSHTEADDDRTLYNLIVIRNQQAKDSEEWQKLNYDIHTLRQVRREVRNRWKCILEDLGFQKEADSLLSVTKLSTISDSKNTRKAREMLLKLAEETNIFPTSWELSERYLFVVDRL

SEQ ID NO: 50190 - protein, 214 aa, Homo sapiens; identical to SEQ ID NO: 50186
  Payload ID: 10036
  Gene Symbol: MREG
  Gene Name: melanoregulin
  Uniprot ID: Q8N565
  ENSP ID: ENSP00000484331

SEQ ID NO: 50191 - protein, 350 aa, Homo sapiens [sequence omitted]

SEQ ID NO: 50192 - protein, 362 aa, Homo sapiens
  Payload ID: 10038
  Gene Symbol: MTNR1B
  Gene Name: melatonin receptor 1B
  Uniprot ID: P49286
  ENSP ID: ENSP00000257068
MSENGSFANCCEAGGWAVRPGWSGAGSARPSRTPRPPWVAPALSAVLIVTTAVDVVGNLLVILSVLRNRKLRNAGNLFLVSLALADLVVAFYPYPLILVAIFYDGWALGEEHCKASAFVMGLSVIGSVFNITAIAINRYCYICHSMAYHRIYRRWHTPLHICLIWLLTVVALLPNFFVGSLEYDPRIYSCTFIQTASTQYTAAVVVIHFLLPIAVVSFCYLRIWVLVLQARRKAKPESRLCLKPSDLRSFLTMFVVFVIFAICWAPLNCIGLAVAINPQEMAPQIPEGLFVTSYLLAYFNSCLNAIVYGLLNQNFRREYKRILLALWNPRHCIQDASKGSHAEGLQSPAPPIIGVQHQADAL

SEQ ID NO: 50193 - protein, 113 aa, Homo sapiens
  Payload ID: 10038
  Gene Symbol: MTNR1B
  Gene Name: melatonin receptor 1B
  ENSP ID: ENSP00000433573
  MOD_RES (1)..(1): Any amino acid
XGLVGGWQRAALQDPSTSLGGSSAVRGAHRHHRRGRRGQPPGDPLRAQEPQAPERRFLVINQELRESKRMVKPRPRTSSNVHIWNDLMLWALIVNKNAFAETAKFGEACLPPP

SEQ ID NO: 50194 - protein, 79 aa, Homo sapiens
  Payload ID: 10038
  Gene Symbol: MTNR1B
  Gene Name: melatonin receptor 1B
  ENSP ID: ENSP00000436101
MSENGSFANCCEAGGWAVRPGWSGAGSARPSRTPRPPWVAPALSAVLIVTTAVDVVGNLLVILSVLRNRKLRNAGISYL

SEQ ID NO: 50195 - protein, 1287 aa, Homo sapiens
  Payload ID: 10039
  Gene Symbol: MAGI1
  Gene Name: membrane associated guanylate kinase, WW and PDZ domain containing 1
  Uniprot ID: Q96QZ7
  ENSP ID: ENSP00000331157
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYAMIPPNIAACMRNEKLGEACFYLMGHNQTTTPAATATAPPPVHKVFRK

SEQ ID NO: 50196 - protein, 1462 aa, Homo sapiens
  Payload ID: 10039
  Gene Symbol: MAGI1
  Gene Name: membrane associated guanylate kinase, WW and PDZ domain containing 1
  Uniprot ID: Q96QZ7
  ENSP ID: ENSP00000385450
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRLPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYDPSSDRHGPATGPQGVPEVRAGPDRRQHPSLESSYPPDLHKSSPHGEKRAHARDPKGSREYSRQPNEHHTWNGTSRKPDSGACRPKDRAPEGRRDAQAERAAAANGPKRRSPEKRREGTRSADNTLERREKHEKRRDVSPERRRERSPTRRRDGSPSRRRRSLERLLEQRRSPERRRGGSPERRAKSTDRRRARSPERRRERSLDKRNREDRASHREREEANLKQDAGRSSRHPPEQRRRPYKECSTDLSI

SEQ ID NO: 50197 - protein, 185 aa, Homo sapiens
  Payload ID: 10039
  Gene Symbol: MAGI1
  Gene Name: membrane associated guanylate kinase, WW and PDZ domain containing 1
  ENSP ID: ENSP00000418044
EEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDELPAGWEKIEDPVYGIYYVDHINRKTQYENPVLEAKRKKQLEQQQQQQQQQQQQQQQQQQQQTEEWTEDHSALVPP

SEQ ID NO: 50198 - protein, 1131 aa, Homo sapiens
  Payload ID: 10039
  Gene Symbol: MAGI1
  Gene Name: membrane associated guanylate kinase, WW and PDZ domain containing 1
  ENSP ID: ENSP00000418177
AGGSLGTGRRRQRLPATGGTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFAGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYGGSNYENIPSFPGMTP

SEQ ID NO: 50199 - protein, 1136 aa, Homo sapiens
  Payload ID: 10039
  Gene Symbol: MAGI1
  Gene Name: membrane associated guanylate kinase, WW and PDZ domain containing 1
  ENSP ID: ENSP00000418862
  MOD_RES (1)..(1): Any amino acid
XAWWEAVSGSQREGLILAIGLGFAGTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYGGSNYENIPSFPGMTP

SEQ ID NO: 50200 - protein, 1256 aa, Homo sapiens
  Payload ID: 10039
  Gene Symbol: MAGI1
  Gene Name: membrane associated guanylate kinase, WW and PDZ domain containing 1
  Uniprot ID: Q96QZ7
  ENSP ID: ENSP00000420323
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFAGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYGGSNYENIPSFPGMTP

SEQ ID NO: 50201 - protein, 1014 aa, Homo sapiens
  Payload ID: 10039
  Gene Symbol: MAGI1
  Gene Name: membrane associated guanylate kinase, WW and PDZ domain containing 1
  ENSP ID: ENSP00000420796
KQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRLPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFAGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYGGSNYENIPSFPGMTP

SEQ ID NO: 50202 - protein, 1160 aa, Homo sapiens
  Payload ID: 10039
  Gene Symbol: MAGI1
  Gene Name: membrane associated guanylate kinase, WW and PDZ domain containing 1
  Uniprot ID: Q96QZ7
  ENSP ID: ENSP00000424369
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRLPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYGGSNYENIPSFPGMTP

SEQ ID NO: 50203 - protein, 1155 aa, Homo sapiens
  Payload ID: 10039
  Gene Symbol: MAGI1
  Gene Name: membrane associated guanylate kinase, WW and PDZ domain containing 1
  ENSP ID: ENSP00000477591
MAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRLPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYDPSSDRHGPATGPQGVPEVRAGPDRRQHPSLESSYPPDLHKSSPHGEKRAHARDPKGSREYSRQPNEHHTWNGTSRKPDSGACRPKDRAPEGRRDAQAERAAAANGPKRRSPEKRREGTRSADNTLERREKHEKRRDVSPERRRERSPTRRRDGSPSRRRRSLERLLEQRRSPERRRGGSPERRAKSTDRRRARSPERRRERSLDKRNREDRASHREREEANLKQDAGRSSRHPPEQRRRPYKECSTDLSI

SEQ ID NO: 50204 - protein, 980 aa, Homo sapiens
  Payload ID: 10039
  Gene Symbol: MAGI1
  Gene Name: membrane associated guanylate kinase, WW and PDZ domain containing 1
  ENSP ID: ENSP00000480920
MAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYAMIPPNIAACMRNEKLGEACFYLMGHNQTTTPAATATAPPPVHKVFRK

SEQ ID NO: 50205 - protein, 1155 aa, Homo sapiens; identical to SEQ ID NO: 50203
  Payload ID: 10039
  Gene Symbol: MAGI1
  Gene Name: membrane associated guanylate kinase, WW and PDZ domain containing 1
  ENSP ID: ENSP00000489105

SEQ ID NO: 50206 - protein, 1160 aa, Homo sapiens; identical to SEQ ID NO: 50202
  Payload ID: 10039
  Gene Symbol: MAGI1
  Gene Name: membrane associated guanylate kinase, WW and PDZ domain containing 1
  ENSP ID: ENSP00000489322

SEQ ID NO: 50207 - protein, 1131 aa, Homo sapiens; identical to SEQ ID NO: 50198
  Payload ID: 10039
  Gene Symbol: MAGI1
  Gene Name: membrane associated guanylate kinase, WW and PDZ domain containing 1
  ENSP ID: ENSP00000489326

SEQ ID NO: 50208 - protein, 1256 aa, Homo sapiens; identical to SEQ ID NO: 50200
  Payload ID: 10039
  Gene Symbol: MAGI1
  Gene Name: membrane associated guanylate kinase, WW and PDZ domain containing 1
  ENSP ID: ENSP00000489391

SEQ ID NO: 50209 - protein, 1287 aa, Homo sapiens; identical to SEQ ID NO: 50195
  Payload ID: 10039
  Gene Symbol: MAGI1
  Gene Name: membrane associated guanylate kinase, WW and PDZ domain containing 1
  ENSP ID: ENSP00000489393

SEQ ID NO: 50210 - protein, 1462 aa, Homo sapiens; identical to SEQ ID NO: 50196
  Payload ID: 10039
  Gene Symbol: MAGI1
  Gene Name: membrane associated guanylate kinase, WW and PDZ domain containing 1
  ENSP ID: ENSP00000489444

SEQ ID NO: 50211 - protein, 185 aa, Homo sapiens; identical to SEQ ID NO: 50197
  Payload ID: 10039
  Gene Symbol: MAGI1
  Gene Name: membrane associated guanylate kinase, WW and PDZ domain containing 1
  ENSP ID: ENSP00000489449

SEQ ID NO: 50212 - protein, 1014 aa, Homo sapiens; identical to SEQ ID NO: 50201
  Payload ID: 10039
  Gene Symbol: MAGI1
  Gene Name: membrane associated guanylate kinase, WW and PDZ domain containing 1
  ENSP ID: ENSP00000489478

SEQ ID NO: 50213 - protein, 980 aa, Homo sapiens; identical to SEQ ID NO: 50204
  Payload ID: 10039
  Gene Symbol: MAGI1
  Gene Name: membrane associated guanylate kinase, WW and PDZ domain containing 1
  ENSP ID: ENSP00000489513

SEQ ID NO: 50214 - protein, 1136 aa, Homo sapiens; identical to SEQ ID NO: 50199
  Payload ID: 10039
  Gene Symbol: MAGI1
  Gene Name: membrane associated guanylate kinase, WW and PDZ domain containing 1
  ENSP ID: ENSP00000489580
  MOD_RES (1)..(1): Any amino acid

SEQ ID NO: 50215 - protein, 1455 aa, Homo sapiens
  Payload ID: 10040
  Gene Symbol: MAGI2
  Gene Name: membrane associated guanylate kinase, WW and PDZ domain containing 2
  Uniprot ID: Q86UL8
  ENSP ID: ENSP00000346151
MSKSLKKKSHWTSKVHESVIGRNPEGQLGFELKGGAENGQFPYLGEVKPGKVAYESGSKLVSEELLLEVNETPVAGLTIRDVLAVIKHCKDPLRLKCVKQGGIVDKDLRHYLNLRFQKGSVDHELQQIIRDNLYLRTVPCTTRPHKEGEVPGVDYIFITVEDFMELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRQQVPPRTSFRMDSSGPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYDEPAPWSSPAAAAPGLPEVGVSLDDGLAPFSPSHPAPPSDPSHQISPGPTWDIKREHDVRKPKELSACGQKKQRLGEQRERSASPQRAARPRLEEAPGGQGRPEAGRPASEARAPGLAAADAADAARAGGKEAPRAAAGSELCRREGPGAAPAFAGPGGGGSGALEAEGRAGARAGPRPGPRPPGGAPARKAAVAPGPWKVPGSDKLPSVLKPGASAASR

SEQ ID NO: 50216 - protein, 1441 aa, Homo sapiens
  Payload ID: 10040
  Gene Symbol: MAGI2
  Gene Name: membrane associated guanylate kinase, WW and PDZ domain containing 2
  Uniprot ID: Q86UL8
  ENSP ID: ENSP00000405766
MSKSLKKKSHWTSKVHESVIGRNPEGQLGFELKGGAENGQFPYLGEVKPGKVAYESGSKLVSEELLLEVNETPVAGLTIRDVLAVIKHCKDPLRLKCVKQGGIVDKDLRHYLNLRFQKGSVDHELQQIIRDNLYLRTVPCTTRPHKEGEVPGVDYIFITVEDFMELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRRPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYDEPAPWSSPAAAAPGLPEVGVSLDDGLAPFSPSHPAPPSDPSHQISPGPTWDIKREHDVRKPKELSACGQKKQRLGEQRERSASPQRAARPRLEEAPGGQGRPEAGRPASEARAPGLAAADAADAARAGGKEAPRAAAGSELCRREGPGAAPAFAGPGGGGSGALEAEGRAGARAGPRPGPRPPGGAPARKAAVAPGPWKVPGSDKLPSVLKPGASAASR

SEQ ID NO: 50217 - protein, 1283 aa, Homo sapiens
  Payload ID: 10040
  Gene Symbol: MAGI2
  Gene Name: membrane associated guanylate kinase, WW and PDZ domain containing 2
  ENSP ID: ENSP00000428389
MSKSLKKKSHWTSKVHESVIGRNPEGQLGFELKGGAENGQFPYLGEVKPGKVAYESGSKLVSEELLLEVNETPVAGLTIRDVLAVIKHCKDPLRLKCVKQGGIVDKDLRHYLNLRFQKGSVDHELQQIIRDNLYLRTVPCTTRPHKEGEVPGVDYIFITVEDFMELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRQQVPPRTSFRMDSSGPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYGMVPSSLSMCMKSDKHGSPYFYLLGHPKDTTNPPPGVLPLPPPQVCRK

SEQ ID NO: 50218 - protein, 1303 aa, Homo sapiens [sequence omitted]

SEQ ID NO: 50219 - protein, 555 aa, Homo sapiens
  Payload ID: 10040
  Gene Symbol: MAGI2
  Gene Name: membrane associated guanylate kinase, WW and PDZ domain containing 2
  ENSP ID: ENSP00000485970
MELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGKTNTGSAIKYVGKIVGSFNNIVKMQISLELNEIIL

SEQ ID NO: 50220 - protein, 1120 aa, Homo sapiens
  Payload ID: 10040
  Gene Symbol: MAGI2
  Gene Name: membrane associated guanylate kinase, WW and PDZ domain containing 2
  ENSP ID: ENSP00000486131
MELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRQQVPPRTSFRMDSSGPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYGMVPSSLSMCMKSDKHGSPYFYLLGHPKDTTNPPPGVLPLPPPQVCRK

SEQ ID NO: 50221 - protein, 238 aa, Homo sapiens
  Payload ID: 10040
  Gene Symbol: MAGI2
  Gene Name: membrane associated guanylate kinase, WW and PDZ domain containing 2
  ENSP ID: ENSP00000486154
IMDRWENQGSPQTSLSAPAIPQNLPFPPALHRSSFPDSTEAFDPRKPDPYELYEKSRAIYEKQVPPRTSFRMDSSGPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGF

SEQ ID NO: 50222 - protein, 183 aa, Homo sapiens
  Payload ID: 10040
  Gene Symbol: MAGI2
  Gene Name: membrane associated guanylate kinase, WW and PDZ domain containing 2
  ENSP ID: ENSP00000486379
RMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTIIFQSSFSSLQAVEQKRG

SEQ ID NO: 50223 - protein, 861 aa, Homo sapiens
  Payload ID: 10040
  Gene Symbol: MAGI2
  Gene Name: membrane associated guanylate kinase, WW and PDZ domain containing 2
  ENSP ID: ENSP00000486774
MPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYGTFHVLIHPFALPSVNHKCLWLFIKLHQFSTST

SEQ ID NO: 50224 - protein, 105 aa, Homo sapiens
  Payload ID: 10040
  Gene Symbol: MAGI2
  Gene Name: membrane associated guanylate kinase, WW and PDZ domain containing 2
  ENSP ID: ENSP00000487001
HAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTISKC

SEQ ID NO: 50225 - protein, 495 aa, Homo sapiens
  Payload ID: 10040
  Gene Symbol: MAGI2
  Gene Name: membrane associated guanylate kinase, WW and PDZ domain containing 2
  ENSP ID: ENSP00000487435
MEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGKTNTGSAIKYVGKIVGSFNNIVKMQISLELNEIIL

SEQ ID NO: 50226 - protein, 1106 aa, Homo sapiens
  Payload ID: 10040
  Gene Symbol: MAGI2
  Gene Name: membrane associated guanylate kinase, WW and PDZ domain containing 2
  ENSP ID: ENSP00000487448
MELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRRPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYGMVPSSLSMCMKSDKHGSPYFYLLGHPKDTTNPPPGVLPLPPPQVCRK

SEQ ID NO: 50227 - protein, 1317 aa, Homo sapiens [sequence omitted]

SEQ ID NO: 50228 - protein, 75 aa, Homo sapiens
  Payload ID: 10040
  Gene Symbol: MAGI2
  Gene Name: membrane associated guanylate kinase, WW and PDZ domain containing 2
  ENSP ID: ENSP00000489533
MPHTELGTKPLQAPGFRVDSSSWTLPRPKSIRPRAAPERSRSVNDLSYYQRDPAGRPWLFEKPLFTRDASQLKGT

SEQ ID NO: 50229 - protein, 1481 aa, Homo sapiens
  Payload ID: 10041
  Gene Symbol: MAGI3
  Gene Name: membrane associated guanylate kinase, WW and PDZ domain containing 3
  Uniprot ID: Q5TCQ9
  ENSP ID: ENSP00000304604
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGDWDINNPSSSNVIYDEQSPLPPSSHFASIFEESHVPVIEESLRVQICEKAEELKDIVPEKKSTLNENQPEIKHQSLLQKNVSKRDPPSSHGHSNKKNLLKVENGVTRRGRSVSPKKPASQHSEEHLDKIPSPLKNNPKRRPRDQSLSPSKGENKSCQVSTRAGSGQDQCRKSRGRSASPKKQQKIEGSKAPSNAEAKLLEGKSRRIAGYTGSNAEQIPDGKEKSDVIRKDAKQNQLEKSRTRSPEKKIKRMVEKSLPSKMTNKTTSKEVSENEKGKKVTTGETSSSNDKIGENVQLSEKRLKQEPEEKVVSNKTEDHKGKELEAADKNKETGRFKPESSSPVKKTLITPGPWKVPSGNKVTGTIGMAEKRQ

SEQ ID NO: 50230 - protein, 1125 aa, Homo sapiens
  Payload ID: 10041
  Gene Symbol: MAGI3
  Gene Name: membrane associated guanylate kinase, WW and PDZ domain containing 3
  Uniprot ID: Q5TCQ9
  ENSP ID: ENSP00000358624
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGLAPSGLCSYVKPEQH

SEQ ID NO: 50231 - protein, 1125 aa, Homo sapiens; identical to SEQ ID NO: 50230
  Payload ID: 10041
  Gene Symbol: MAGI3
  Gene Name: membrane associated guanylate kinase, WW and PDZ domain containing 3
  Uniprot ID: Q5TCQ9
  ENSP ID: ENSP00000358628

SEQ ID NO: 50232 - protein, 1150 aa, Homo sapiens
  Payload ID: 10041
  Gene Symbol: MAGI3
  Gene Name: membrane associated guanylate kinase, WW and PDZ domain containing 3
  Uniprot ID: Q5TCQ9
  ENSP ID: ENSP00000358630
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDFTLVAQAGVQWHDLGSLQPPPPGFNHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGLAPSGLCSYVKPEQH

SEQ ID NO: 50233 - protein, 495 aa, Homo sapiens
  Payload ID: 10042
  Gene Symbol: MBOAT1
  Gene Name: membrane bound O-acyltransferase domain containing 1
  Uniprot ID: Q6ZNC8
  ENSP ID: ENSP00000324944
MAAEPQPSSLSYRTTGSTYLHPLSELLGIPLDQVNFVVCQLVALFAAFWFRIYLRPGTTSSDVRHAVATIFGIYFVIFCFGWYSVHLFVLVLMCYAIMVTASVSNIHRYSFFVAMGYLTICHISRIYIFHYGILTTDFSGPLMIVTQKITTLAFQVHDGLGRRAEDLSAEQHRLAIKVKPSFLEYLSYLLNFMSVIAGPCNNFKDYIAFIEGKHIHMKLLEVNWKRKGFHSLPEPSPTGAVIHKLGITLVSLLLFLTLTKTFPVTCLVDDWFVHKASFPARLCYLYVVMQASKPKYYFAWTLADAVNNAAGFGFSGVDKNGNFCWDLLSNLNIWKIETATSFKMYLENWNIQTATWLKCVCYQRVPWYPTVLTFILSALWHGVYPGYYFTFLTGILVTLAARAVRNNYRHYFLSSRALKAVYDAGTWAVTQLAVSYTVAPFVMLAVEPTISLYKSMYFYLHIISLLIILFLPMKPQAHTQRRPQTLNSINKRKTD

SEQ ID NO: 50234 - protein, 520 aa, Homo sapiens
  Payload ID: 10043
  Gene Symbol: MBOAT2
  Gene Name: membrane bound O-acyltransferase domain containing 2
  Uniprot ID: Q6ZWT7
  ENSP ID: ENSP00000302177
MATTSTTGSTLLQPLSNAVQLPIDQVNFVVCQLFALLAAIWFRTYLHSSKTSSFIRHVVATLLGLYLALFCFGWYALHFLVQSGISYCIMIIIGVENMHNYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYITFIEGRSYHITQSGENGKEETQYERTEPSPNTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRVCYERTSFSPTIQTFILSAIWHGVYPGYYLTFLTGVLMTLAARAMRNNFRHYFIEPSQLKLFYDVITWIVTQVAISYTVVPFVLLSIKPSLTFYSSWYYCLHILGILVLLLLPVKKTQRRKNTHENIQLSQSKKFDEGENSLGQNSFSTTNNVCNQNQEIASRHSSLKQ

SEQ ID NO: 50235 - protein, 176 aa, Homo sapiens
  Payload ID: 10043
  Gene Symbol: MBOAT2
  Gene Name: membrane bound O-acyltransferase domain containing 2
  ENSP ID: ENSP00000417409
MATTSTTGSTLLQPLSNAVQLPIDQAARHMIPGCLSPSVCLTYLAESTGEKYALHFLVQSGISYCIMIIIGVENMHNYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYI

SEQ ID NO: 50236 - protein, 158 aa, Homo sapiens
  Payload ID: 10043
  Gene Symbol: MBOAT2
  Gene Name: membrane bound O-acyltransferase domain containing 2
  ENSP ID: ENSP00000419573
KDYITFIEGRSYHITQSGENGKEETQYERTEPSPNTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRIF

SEQ ID NO: 50237 - protein, 46 aa, Homo sapiens
  Payload ID: 10043
  Gene Symbol: MBOAT2
  Gene Name: membrane bound O-acyltransferase domain containing 2
  ENSP ID: ENSP00000420114
MATTSTTGSTLLQPLSNAVQLPIDQLLLCVCSGIPHSVPSYSSLYL

SEQ ID NO: 50238 - protein, 435 aa, Homo sapiens
  Payload ID: 10044
  Gene Symbol: MBOAT4
  Gene Name: membrane bound O-acyltransferase domain containing 4
  Uniprot ID: Q96T53
  ENSP ID: ENSP00000314196
MEWLWLFFLHPISFYQGAAFPFALLFNYLCIMDSFSTRARYLFLLTGGGALAVAAMGSYAVLVFTPAVCAVALLCSLAPQQVHRWTFCFQMSWQTLCHLGLHYTEYYLHEPPSVRFCITLSSLMLLTQRVTSLSLDICEGKVKAASGGFRSRSSLSEHVCKALPYFSYLLFFPALLGGSLCSFQRFQARVQGSSALHPRHSFWALSWRGLQILGLECLNVAVSRVVDAGAGLTDCQQFECIYVVWTTAGLFKLTYYSHWILDDSLLHAAGFGPELGQSPGEEGYVPDADIWTLERTHRISVFSRKWNQSTARWLRRLVFQHSRAWPLLQTFAFSAWWHGLHPGQVFGFVCWAVMVEADYLIHSFANEFIRSWPMRLFYRTLTWAHTQLIIAYIMLAVEVRSLSSLWLLCNSYNSVFPMVYCILLLLLAKRKHKCN

SEQ ID NO: 50239 - protein, 472 aa, Homo sapiens
  Payload ID: 10045
  Gene Symbol: MBOAT7
  Gene Name: membrane bound O-acyltransferase domain containing 7
  Uniprot ID: Q96N66
  ENSP ID: ENSP00000245615
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 50240 - protein, 399 aa, Homo sapiens
  Payload ID: 10045
  Gene Symbol: MBOAT7
  Gene Name: membrane bound O-acyltransferase domain containing 7
  Uniprot ID: Q96N66
  ENSP ID: ENSP00000344377
MGSSRCGPGAHPVHLWPPHFAFSGHHPRDLGPHSGPALLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 50241 - protein, 344 aa, Homo sapiens
  Payload ID: 10045
  Gene Symbol: MBOAT7
  Gene Name: membrane bound O-acyltransferase domain containing 7
  Uniprot ID: Q96N66
  ENSP ID: ENSP00000375634
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLR

SEQ ID NO: 50242 - protein, 256 aa, Homo sapiens
  Payload ID: 10045
  Gene Symbol: MBOAT7
  Gene Name: membrane bound O-acyltransferase domain containing 7
  ENSP ID: ENSP00000388250
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGC

SEQ ID NO: 50243 - protein, 70 aa, Homo sapiens
  Payload ID: 10045
  Gene Symbol: MBOAT7
  Gene Name: membrane bound O-acyltransferase domain containing 7
  ENSP ID: ENSP00000404915
MSPEEWTYLVVLLISIPIGFLFKKAGPGLKRWGAAAVGLGLTLFTCGPHTLHSLVTILGTWALIQAQPCW

SEQ ID NO: 50244 - protein, 123 aa, Homo sapiens
  Payload ID: 10045
  Gene Symbol: MBOAT7
  Gene Name: membrane bound O-acyltransferase domain containing 7
  ENSP ID: ENSP00000406794
HTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGAPGPCC

SEQ ID NO: 50245 - protein, 170 aa, Homo sapiens
  Payload ID: 10045
  Gene Symbol: MBOAT7
  Gene Name: membrane bound O-acyltransferase domain containing 7
  ENSP ID: ENSP00000410320
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRY

SEQ ID NO: 50246 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  Uniprot ID: Q96N66
  ENSP ID: ENSP00000410503

SEQ ID NO: 50247 - protein, 181 aa, Homo sapiens
  Payload ID: 10045
  Gene Symbol: MBOAT7
  Gene Name: membrane bound O-acyltransferase domain containing 7
  ENSP ID: ENSP00000472209
  MOD_RES (1)..(1): Any amino acid
XKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSRSGGAREASQDPAAPTSKGWLCP

SEQ ID NO: 50248 - protein, 256 aa, Homo sapiens; identical to SEQ ID NO: 50242
  Payload ID: 10045
  Gene Symbol: MBOAT7
  Gene Name: membrane bound O-acyltransferase domain containing 7
  ENSP ID: ENSP00000477618

SEQ ID NO: 50249 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000477891

SEQ ID NO: 50250 - protein, 472 aa, Homo sapiens; identical to SEQ ID NO: 50239
  Payload ID: 10045
  Gene Symbol: MBOAT7
  Gene Name: membrane bound O-acyltransferase domain containing 7
  ENSP ID: ENSP00000478041

SEQ ID NO: 50251 - protein, 472 aa, Homo sapiens; identical to SEQ ID NO: 50239
  Payload ID: 10045
  Gene Symbol: MBOAT7
  Gene Name: membrane bound O-acyltransferase domain containing 7
  ENSP ID: ENSP00000478088

SEQ ID NO: 50252 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  Uniprot ID: Q96N66
  ENSP ID: ENSP00000478522

SEQ ID NO: 50253 - protein, 256 aa, Homo sapiens; identical to SEQ ID NO: 50242
  Payload ID: 10045
  Gene Symbol: MBOAT7
  Gene Name: membrane bound O-acyltransferase domain containing 7
  ENSP ID: ENSP00000478623

SEQ ID NO: 50254 - protein, 472 aa, Homo sapiens; identical to SEQ ID NO: 50239
  Payload ID: 10045
  Gene Symbol: MBOAT7
  Gene Name: membrane bound O-acyltransferase domain containing 7
  ENSP ID: ENSP00000478965

SEQ ID NO: 50255 - protein, 170 aa, Homo sapiens; identical to SEQ ID NO: 50245
  Payload ID: 10045
  Gene Symbol: MBOAT7
  Gene Name: membrane bound O-acyltransferase domain containing 7
  ENSP ID: ENSP00000479717

SEQ ID NO: 50256 - protein, 344 aa, Homo sapiens; identical to SEQ ID NO: 50241
  Payload ID: 10045
  Gene Symbol: MBOAT7
  Gene Name: membrane bound O-acyltransferase domain containing 7
  Uniprot ID: Q96N66
  ENSP ID: ENSP00000479750

SEQ ID NO: 50257 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000479760

SEQ ID NO: 50258 - protein, 256 aa, Homo sapiens; identical to SEQ ID NO: 50242
  Payload ID: 10045
  Gene Symbol: MBOAT7
  Gene Name: membrane bound O-acyltransferase domain containing 7
  ENSP ID: ENSP00000480282

SEQ ID NO: 50259 - protein, 344 aa, Homo sapiens; identical to SEQ ID NO: 50241
  Payload ID: 10045
  Gene Symbol: MBOAT7
  Gene Name: membrane bound O-acyltransferase domain containing 7
  ENSP ID: ENSP00000480531

SEQ ID NO: 50260 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000480575

SEQ ID NO: 50261 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000480894

SEQ ID NO: 50262 - protein, 344 aa, Homo sapiens; identical to SEQ ID NO: 50241
  Payload ID: 10045
  Gene Symbol: MBOAT7
  Gene Name: membrane bound O-acyltransferase domain containing 7
  ENSP ID: ENSP00000481119

SEQ ID NO: 50263 - protein, 70 aa, Homo sapiens; identical to SEQ ID NO: 50243
  Payload ID: 10045
  Gene Symbol: MBOAT7
  Gene Name: membrane bound O-acyltransferase domain containing 7
  ENSP ID: ENSP00000481141

SEQ ID NO: 50264 - protein, 472 aa, Homo sapiens; identical to SEQ ID NO: 50239
  Payload ID: 10045
  Gene Symbol: MBOAT7
  Gene Name: membrane bound O-acyltransferase domain containing 7
  Uniprot ID: Q96N66
  ENSP ID: ENSP00000481455

SEQ ID NO: 50265 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000481544

SEQ ID NO: 50266 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000481758

SEQ ID NO: 50267 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000481864

SEQ ID NO: 50268 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000481947

SEQ ID NO: 50269 - protein, 472 aa, Homo sapiens; identical to SEQ ID NO: 50239
  Payload ID: 10045
  Gene Symbol: MBOAT7
  Gene Name: membrane bound O-acyltransferase domain containing 7
  ENSP ID: ENSP00000482252

SEQ ID NO: 50270 - protein, 172 aa, Homo sapiens
  Payload ID: 10045
  Gene Symbol: MBOAT7
  Gene Name: membrane bound O-acyltransferase domain containing 7
  ENSP ID: ENSP00000482316
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRT

SEQ ID NO: 50271 - protein, 181 aa, Homo sapiens; identical to SEQ ID NO: 50247
  Payload ID: 10045
  Gene Symbol: MBOAT7
  Gene Name: membrane bound O-acyltransferase domain containing 7
  ENSP ID: ENSP00000482357
  MOD_RES (1)..(1): Any amino acid

SEQ ID NO: 50272 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000482369

SEQ ID NO: 50273 - protein, 472 aa, Homo sapiens; identical to SEQ ID NO: 50239
  Payload ID: 10045
  Gene Symbol: MBOAT7
  Gene Name: membrane bound O-acyltransferase domain containing 7
  ENSP ID: ENSP00000482625

SEQ ID NO: 50274 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000482742

SEQ ID NO: 50275 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000482884

SEQ ID NO: 50276 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  ENSP ID: ENSP00000483526

SEQ ID NO: 50277 - protein, 123 aa, Homo sapiens; identical to SEQ ID NO: 50244
  Payload ID: 10045
  Gene Symbol: MBOAT7
  Gene Name: membrane bound O-acyltransferase domain containing 7
  ENSP ID: ENSP00000483561

SEQ ID NO: 50278 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  Uniprot ID: Q96N66
  ENSP ID: ENSP00000483839

SEQ ID NO: 50279 - protein, 399 aa, Homo sapiens; identical to SEQ ID NO: 50240
  Payload ID: 10045
  Gene Symbol: MBOAT7
  Gene Name: membrane bound O-acyltransferase domain containing 7
  Uniprot ID: Q96N66
  ENSP ID: ENSP00000483987

SEQ ID NO: 50280 - protein, 172 aa, Homo sapiens; identical to SEQ ID NO: 50270
  Payload ID: 10045
  Gene Symbol: MBOAT7
  Gene Name: membrane bound O-acyltransferase domain containing 7
  ENSP ID: ENSP00000484102

SEQ ID NO: 50281 - protein, 472 aa, Homo sapiens; identical to SEQ ID NO: 50239
  Payload ID: 10045
  Gene Symbol: MBOAT7
  Gene Name: membrane bound O-acyltransferase domain containing 7
  ENSP ID: ENSP00000484199

SEQ ID NO: 50282 - protein, 472 aa, Homo sapiens; identical to SEQ ID NO: 50239
  Payload ID: 10045
  Gene Symbol: MBOAT7
  Gene Name: membrane bound O-acyltransferase domain containing 7
  Uniprot ID: Q96N66
  ENSP ID: ENSP00000484933

SEQ ID NO: 50283 - protein, 472 aa, Homo sapiens; identical to SEQ ID NO: 50239
  Payload ID: 10045
  Gene Symbol: MBOAT7
  Gene Name: membrane bound O-acyltransferase domain containing 7
  ENSP ID: ENSP00000484954

SEQ ID NO: 50284 - protein, 461 aa, Homo sapiens
  Payload ID: 10046
  Gene Symbol: MFRP
  Gene Name: membrane frizzled-related protein
  Uniprot ID: Q9BY79
  ENSP ID: ENSP00000353291
MKDFSDVILCMEATESSKTEFCNPAFEPESGPPCPPPVFPEDASYSVPAPWHGRRPRGLRPDCRFSWLCVLLLSSLLLLLLGLLVAIILAQLQAAPPSGASHSPLPAGGLTTTTTTPTITTSQAAGTPKGQQESGVSPSPQSTCGGLLSGPRGFFSSPNYPDPYPPNTHCVWHIQVATDHAIQLKIEALSIESVASCLFDRLELSPEPEGPLLRVCGRVPPPTLNTNASHLLVVFVSDSSVEGFGFHAWYQAMAPGRGSCAHDEFRCDQLICLLPDSVCDGFANCADGSDETNCSAKFSGSVEQSHPPTSSPRTMSWLCCLGQIMASAVEASQPPTWPSMPRRTPVGPVSSPARQEGVRVCSGCVTCGETAPMAAMTTAAAPCSHPQSLTSLPCYQHFRRLLCGLLVPRCTPLGSVLPPCRSVCQEAEHQCQSGLALLGTPWPFNCNRLPEAADLEACAQP

SEQ ID NO: 50285 - protein, 188 aa, Homo sapiens
  Payload ID: 10046
  Gene Symbol: MFRP
  Gene Name: membrane frizzled-related protein
  Uniprot ID: Q9BY79
  ENSP ID: ENSP00000391664
  MOD_RES (1)..(1): Any amino acid
XHLVSSHHELAVLFRTDHGISSGGFSATYLAFNATESRCPWANPCGPSELSCQAGGCKGVQWMCDMWRDCTDGSDDNCSGPLFPPPELACEPVQVEMCLGLSYNTTAFPNIWVGMITQEEVVEVLSGYKSLTSLPCYQHFRRLLCGLLVPRCTPLGSVLPPCRSVCQEAEHQCQSGLALLGTPWPFNC

SEQ ID NO: 50286 - protein, 579 aa, Homo sapiens
  Payload ID: 10046
  Gene Symbol: MFRP
  Gene Name: membrane frizzled-related protein
  Uniprot ID: Q9BY79
  ENSP ID: ENSP00000481824
MKDFSDVILCMEATESSKTEFCNPAFEPESGPPCPPPVFPEDASYSVPAPWHGRRPRGLRPDCRFSWLCVLLLSSLLLLLLGLLVAIILAQLQAAPPSGASHSPLPAGGLTTTTTTPTITTSQAAGTPKGQQESGVSPSPQSTCGGLLSGPRGFFSSPNYPDPYPPNTHCVWHIQVATDHAIQLKIEALSIESVASCLFDRLELSPEPEGPLLRVCGRVPPPTLNTNASHLLVVFVSDSSVEGFGFHAWYQAMAPGRGSCAHDEFRCDQLICLLPDSVCDGFANCADGSDETNCSAKFSGCGGNLTGLQGTFSTPSYLQQYPHQLLCTWHISVPAGHSIELQFHNFSLEAQDECKFDYVEVYETSSSGAFSLLGRFCGAEPPPHLVSSHHELAVLFRTDHGISSGGFSATYLAFNATENPCGPSELSCQAGGCKGVQWMCDMWRDCTDGSDDNCSGPLFPPPELACEPVQVEMCLGLSYNTTAFPNIWVGMITQEEVVEVLSGYKSLTSLPCYQHFRRLLCGLLVPRCTPLGSVLPPCRSVCQEAEHQCQSGLALLGTPWPFNCNRLPEAADLEACAQP

SEQ ID NO: 50287 - protein, 101 aa, Homo sapiens
  Payload ID: 10046
  Gene Symbol: MFRP
  Gene Name: membrane frizzled-related protein
  ENSP ID: ENSP00000488979
MKDFSDVILCMEATESSKVGVLEGYGQTAASPGSVSSCSPACSSCCLGCWWPSSWPSCRLHPHLGRPIAHCLPEALPRPPPPPPSPPLRQLGPLKGSRSQA

SEQ ID NO: 50288 - protein, 131 aa, Homo sapiens
  Payload ID: 10047
  Gene Symbol: MMGT1
  Gene Name: membrane magnesium transporter 1
  Uniprot ID: Q8N4V1
  ENSP ID: ENSP00000306220
MAPSLWKGLVGIGLFALAHAAFSAAQHRSYMRLTEKEDESLPIDIVLQTLLAFAVTCYGIVHIAGEFKDMDATSELKNKTFDTLRNHPSFYVFNHRGRVLFRPSDTANSSNQDALSSNTSLKLRKLESLRR

SEQ ID NO: 50289 - protein, 750 aa, Homo sapiens
  Payload ID: 10048
  Gene Symbol: MME
  Gene Name: membrane metallo-endopeptidase
  Uniprot ID: P08473
  ENSP ID: ENSP00000353679
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYECTGIYKEACTAYVDFMISVARLIRQEERLPIDENQLALEMNKVMELEKEIANATAKPEDRNDPMLLYNKMTLAQIQNNFSLEINGKPFSWLNFTNEIMSTVNISITNEEDVVVYAPEYLTKLKPILTKYSARDLQNLMSWRFIMDLVSSLSRTYKESRNAFRKALYGTTSETATWRRCANYVNGNMENAVGRLYVEAAFAGESKHVVEDLIAQIREVFIQTLDDLTWMDAETKKRAEEKALAIKERIGYPDDIVSNDNKLNNEYLELNYKEDEYFENIIQNLKFSQSKQLKKLREKVDKDEWISGAAVVNAFYSSGRNQIVFPAGILQPPFFSAQQSNSLNYGGIGMVIGHEITHGFDDNGRNFNKDGDLVDWWTQQSASNFKEQSQCMVYQYGNFSWDLAGGQHLNGINTLGENIADNGGLGQAYRAYQNYIKKNGEEKLLPGLDLNHKQLFFLNFAQVWCGTYRPEYAVNSIKTDVHSPGNFRIIGTLQNSAEFSEAFHCRKNSYMNPEKKCRVW

SEQ ID NO: 50290 - protein, 80 aa, Homo sapiens
  Payload ID: 10048
  Gene Symbol: MME
  Gene Name: membrane metallo-endopeptidase
  ENSP ID: ENSP00000372450
MGKSESQMDITDINTPKPKKKQRWTPLEISLSVLVLLLTIIAVTMIALYATYDDGICKSSDCIKSGMVARAYNPRGRRIA

SEQ ID NO: 50291 - protein, 750 aa, Homo sapiens; identical to SEQ ID NO: 50289
  Payload ID: 10048
  Gene Symbol: MME
  Gene Name: membrane metallo-endopeptidase
  Uniprot ID: P08473
  ENSP ID: ENSP00000417079

SEQ ID NO: 50292 - protein, 161 aa, Homo sapiens
  Payload ID: 10048
  Gene Symbol: MME
  Gene Name: membrane metallo-endopeptidase
  ENSP ID: ENSP00000417595
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLL

SEQ ID NO: 50293 - protein, 15 aa, Homo sapiens
  Payload ID: 10048
  Gene Symbol: MME
  Gene Name: membrane metallo-endopeptidase
  ENSP ID: ENSP00000418238
MGKSESQMDITDINT

SEQ ID NO: 50294 - protein, 750 aa, Homo sapiens; identical to SEQ ID NO: 50289
  Payload ID: 10048
  Gene Symbol: MME
  Gene Name: membrane metallo-endopeptidase
  Uniprot ID: P08473
  ENSP ID: ENSP00000418525

SEQ ID NO: 50295 - protein, 119 aa, Homo sapiens
  Payload ID: 10048
  Gene Symbol: MME
  Gene Name: membrane metallo-endopeptidase
  ENSP ID: ENSP00000418791
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLK

SEQ ID NO: 50296 - protein, 750 aa, Homo sapiens; identical to SEQ ID NO: 50289
  Payload ID: 10048
  Gene Symbol: MME
  Gene Name: membrane metallo-endopeptidase
  Uniprot ID: P08473
  ENSP ID: ENSP00000419653

SEQ ID NO: 50297 - protein, 233 aa, Homo sapiens
  Payload ID: 10048
  Gene Symbol: MME
  Gene Name: membrane metallo-endopeptidase
  ENSP ID: ENSP00000420101
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYE

SEQ ID NO: 50298 - protein, 750 aa, Homo sapiens; identical to SEQ ID NO: 50289
  Payload ID: 10048
  Gene Symbol: MME
  Gene Name: membrane metallo-endopeptidase
  Uniprot ID: P08473
  ENSP ID: ENSP00000420389

SEQ ID NO: 50299 - protein, 93 aa, Homo sapiens
  Payload ID: 10048
  Gene Symbol: MME
  Gene Name: membrane metallo-endopeptidase
  ENSP ID: ENSP00000420542
MGKSESQMDITDINTPKPKKKQRWTPLEISLSVLVLLLTIIAVTMIALYATYDDGICKSSDCIKSAARLIQNMDATTEPCTDFFKYACGGWLK

SEQ ID NO: 50300 - protein, 750 aa, Homo sapiens; identical to SEQ ID NO: 50289
  Payload ID: 10048
  Gene Symbol: MME
  Gene Name: membrane metallo-endopeptidase
  Uniprot ID: P08473
  ENSP ID: ENSP00000478173

SEQ ID NO: 50301 - protein, 79 aa, Homo sapiens
  Payload ID: 10048
  Gene Symbol: MME
  Gene Name: membrane metallo-endopeptidase
  ENSP ID: ENSP00000480349
MGKSESQMDITDINTPKPKKKQRWTPLEISLSVLVLLLTIIAVTMIALYATYDGELLPHLCISASMVARAYNPRGRRIA

SEQ ID NO: 50302 - protein, 80 aa, Homo sapiens; identical to SEQ ID NO: 50290
  Payload ID: 10048
  Gene Symbol: MME
  Gene Name: membrane metallo-endopeptidase
  ENSP ID: ENSP00000485791

SEQ ID NO: 50303 - protein, 779 aa, Homo sapiens
  Payload ID: 10049
  Gene Symbol: MMEL1
  Gene Name: membrane metallo-endopeptidase-like 1
  Uniprot ID: Q495T6
  ENSP ID: ENSP00000367668
MGKSEGPVGMVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKDRPAVEKARTLYRSCMNQSVIEKRGSQPLLDILEVVGGWPVAMDRWNETVGLEWELERQLALMNSQFNRRVLIDLFIWNDDQNSSRHIIYIDQPTLGMPSREYYFNGGSNRKVREAYLQFMVSVATLLREDANLPRDSCLVQEDMVQVLELETQLAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRVLGSLQNLAAFADTFHCARGTPMHPKERCRVW

SEQ ID NO: 50304 - protein, 622 aa, Homo sapiens
  Payload ID: 10049
  Gene Symbol: MMEL1
  Gene Name: membrane metallo-endopeptidase-like 1
  Uniprot ID: Q495T6
  ENSP ID: ENSP00000422492
MGKSEGPVGMVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRVLGSLQNLAAFADTFHCARGTPMHPKERCRVW

SEQ ID NO: 50305 - protein, 611 aa, Homo sapiens
  Payload ID: 10049
  Gene Symbol: MMEL1
  Gene Name: membrane metallo-endopeptidase-like 1
  Uniprot ID: Q495T6
  ENSP ID: ENSP00000425477
MGKSEGPVGMVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKDRPAVEKARTLYRSCMNQSVIEKRGSQPLLDILEVVGGWPVAMDRWNETVGLEWELERQLALMNSQFNRRVLIDLFIWNDDQNSSRHIIYIDQPTLGMPSREYYFNGGSNRKVREAYLQFMVSVATLLREDANLPRDSCLVQEDMVQVLELETQLAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIAYSLSRPWGQYSLPGSSSPPSSARSSHRP

SEQ ID NO: 50306 - protein, 66 aa, Homo sapiens
  Payload ID: 10049
  Gene Symbol: MMEL1
  Gene Name: membrane metallo-endopeptidase-like 1
  ENSP ID: ENSP00000461938
GGVRQAYKVWCGSYRPEFAIQSIKTDVHSPLKYRVLGSLQNLAAFADTFHCARGTPMHPKERCRVW

SEQ ID NO: 50307 - protein, 622 aa, Homo sapiens; identical to SEQ ID NO: 50304
  Payload ID: 10049
  Gene Symbol: MMEL1
  Gene Name: membrane metallo-endopeptidase-like 1
  Uniprot ID: Q495T6
  ENSP ID: ENSP00000482173

SEQ ID NO: 50308 - protein, 779 aa, Homo sapiens; identical to SEQ ID NO: 50303
  Payload ID: 10049
  Gene Symbol: MMEL1
  Gene Name: membrane metallo-endopeptidase-like 1
  Uniprot ID: Q495T6
  ENSP ID: ENSP00000484606

SEQ ID NO: 50309 - protein, 611 aa, Homo sapiens; identical to SEQ ID NO: 50305
  Payload ID: 10049
  Gene Symbol: MMEL1
  Gene Name: membrane metallo-endopeptidase-like 1
  Uniprot ID: Q495T6
  ENSP ID: ENSP00000486668

SEQ ID NO: 50310 - protein, 66 aa, Homo sapiens; identical to SEQ ID NO: 50306
  Payload ID: 10049
  Gene Symbol: MMEL1
  Gene Name: membrane metallo-endopeptidase-like 1
  ENSP ID: ENSP00000487339

SEQ ID NO: 50311 - protein, 131 aa, Homo sapiens
  Payload ID: 10050
  Gene Symbol: MPP1
  Gene Name: membrane protein, palmitoylated 1, 55kDa
  ENSP ID: ENSP00000358544
MTLKASEGESGGSMHTALSDLYLEHLLQKRSRPEAVSHPLNTVTEDMYTNGSPAPGSPAQVKGQEGITLKLNEKQSCTVARILHGGMIHRQGSLHVGDEILEINGTNVTNHSVDQLQKAMKETKGMISLKV

SEQ ID NO: 50312 - protein, 466 aa, Homo sapiens
  Payload ID: 10050
  Gene Symbol: MPP1
  Gene Name: membrane protein, palmitoylated 1, 55kDa
  Uniprot ID: Q00013
  ENSP ID: ENSP00000358547
MTLKASEGESGGSMHTALSDLYLEHLLQKRSRPEAVSHPLNTVTEDMYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEYHFISTEEMTRNISANEFLEFGSYQGNMFGTKFETVHQIHKQNKIAILDIEPQTLKIVRTAELSPFIVFIAPTDQGTQTEALQQLQKDSEAIRSQYAHYFDLSLVNNGVDETLKKLQEAFDQACSSPQWVPVSWVY

SEQ ID NO: 50313 - protein, 241 aa, Homo sapiens
  Payload ID: 10050
  Gene Symbol: MPP1
  Gene Name: membrane protein, palmitoylated 1, 55kDa
  ENSP ID: ENSP00000377163
MYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVL

SEQ ID NO: 50314 - protein, 446 aa, Homo sapiens
  Payload ID: 10050
  Gene Symbol: MPP1
  Gene Name: membrane protein, palmitoylated 1, 55kDa
  Uniprot ID: Q00013
  ENSP ID: ENSP00000377165
MTLKASEGESGGSMHTALSDLYLEHLLQKRSRPEAVSHPLNTVTEDMYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEYHFISTEEMTRNISANEFLEFGSYQGNMFGTKFETVHQIHKQNKIAILDIEPQTLKIVRTAELSPFIVFIAPTDQGTQTEALQQLQKDSEAIRSQYAHYFDLSLVNNGVDETLKKLQEAFDQACSSPQWVPVSWVY

SEQ ID NO: 50315 - protein, 89 aa, Homo sapiens
  Payload ID: 10050
  Gene Symbol: MPP1
  Gene Name: membrane protein, palmitoylated 1, 55kDa
  ENSP ID: ENSP00000389321
MTLKASEGESGGSMHTALSDLYLEHLLQKRSRPELPLSNCLCPLNPAADVSSEGAFRAAGIATPALCLIKGQRLQNKGQTWSPGLYRIH

SEQ ID NO: 50316 - protein, 156 aa, Homo sapiens
  Payload ID: 10050
  Gene Symbol: MPP1
  Gene Name: membrane protein, palmitoylated 1, 55kDa
  ENSP ID: ENSP00000391701
MTLKASEGESGGSMHTALSDLYLEHLLQKRSRPEKETKGMISLKVIPNQQSRLPALQMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKH

SEQ ID NO: 50317 - protein, 436 aa, Homo sapiens
  Payload ID: 10050
  Gene Symbol: MPP1
  Gene Name: membrane protein, palmitoylated 1, 55kDa
  Uniprot ID: Q00013
  ENSP ID: ENSP00000400155
MESWAVSHPLNTVTEDMYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEYHFISTEEMTRNISANEFLEFGSYQGNMFGTKFETVHQIHKQNKIAILDIEPQTLKIVRTAELSPFIVFIAPTDQGTQTEALQQLQKDSEAIRSQYAHYFDLSLVNNGVDETLKKLQEAFDQACSSPQWVPVSWVY

SEQ ID NO: 50318 - protein, 68 aa, Homo sapiens
  Payload ID: 10050
  Gene Symbol: MPP1
  Gene Name: membrane protein, palmitoylated 1, 55kDa
  ENSP ID: ENSP00000400700
MTLKASEGESGGSMHTALSDLYLEHLLQKRSRPEAGPLVLWCKEGGQCIFAGGTRNPDSRDGWLVNSY

SEQ ID NO: 50319 - protein, 205 aa, Homo sapiens
  Payload ID: 10050
  Gene Symbol: MPP1
  Gene Name: membrane protein, palmitoylated 1, 55kDa
  ENSP ID: ENSP00000410888
MTLKASEGESGGSMHTALSDLYLEHLLQKRSRPEMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEY

SEQ ID NO: 50320 - protein, 552 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000269095
MPVAATNSETAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 50321 - protein, 569 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000366389
MAGSPGSGVSLEGISLESSEEAELQREAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 50322 - protein, 413 aa, Homo sapiens
  Payload ID: 10051
  Gene Symbol: MPP2
  Gene Name: membrane protein, palmitoylated 2 (MAGUK p55 subfamily member 2)
  Uniprot ID: Q14168
  ENSP ID: ENSP00000428136
MVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 50323 - protein, 597 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000428182
MSWAPPPQVGQNLRSQTVLRILNGMEDLMWVAMEERRFRALASFTMPVAATNSETAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 50324 - protein, 140 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000428218
MQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHL

SEQ ID NO: 50325 - protein, 576 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000428286
MPVAATNSETAMQQVLDNLGSLPSATGAAELDLIFLRGIMESPIVRSLAKVIMVLWFMQQNVFVPMKYMLKYFGAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 50326 - protein, 151 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000428354
MPVAATNSETAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHL

SEQ ID NO: 50327 - protein, 189 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000428468
MQQVLDNLGSLPSATGAAELDLIFLRGIMESPIAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRN

SEQ ID NO: 50328 - protein, 143 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000428938
MPVAATNSETAMQQVLDNLGSLPSATGAAELDLIFLRGIMESPIVRSLAKVQCSREAHERLEETKLEAVRDNNLELVQEILRDLAQLAEQSSTAAELAHILQEPHFQSLLETHDSVASKTYETPPPSPGLDPTFSNQPVPPDA

SEQ ID NO: 50329 - protein, 31 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000429364
MPVAATNSETAMQQVLDNLGSLPSATGAAEL

SEQ ID NO: 50330 - protein, 73 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000430349
MPVAATNSETAMQQVLDNLGSLPSATGAAELDLIFLRGIMESPIVRSLAKAHERLEETKLEAVRDNNLELVQE

SEQ ID NO: 50331 - protein, 126 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000430443
MPVAATNSETAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDP

SEQ ID NO: 50332 - protein, 541 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000430540
MQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 50333 - protein, 148 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000430797
MPVAATNSETAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAG

SEQ ID NO: 50334 - protein, 541 aa, Homo sapiens; identical to SEQ ID NO: 50332
  Payload ID: 10051
  Gene Symbol: MPP2
  Gene Name: membrane protein, palmitoylated 2 (MAGUK p55 subfamily member 2)
  ENSP ID: ENSP00000438012

SEQ ID NO: 50335 - protein, 552 aa, Homo sapiens; identical to SEQ ID NO: 50320
  Payload ID: 10051
  Gene Symbol: MPP2
  Gene Name: membrane protein, palmitoylated 2 (MAGUK p55 subfamily member 2)
  ENSP ID: ENSP00000478528

SEQ ID NO: 50336 - protein, 186 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000479767
MQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDP

SEQ ID NO: 50337 - protein, 541 aa, Homo sapiens; identical to SEQ ID NO: 50332
  Payload ID: 10051
  Gene Symbol: MPP2
  Gene Name: membrane protein, palmitoylated 2 (MAGUK p55 subfamily member 2)
  ENSP ID: ENSP00000480071

SEQ ID NO: 50338 - protein, 112 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000483278
MPVAATNSETAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVAS

SEQ ID NO: 50339 - protein, 573 aa, Homo sapiens
  Payload ID: 10051
  Gene Symbol: MPP2
  Gene Name: membrane protein, palmitoylated 2 (MAGUK p55 subfamily member 2)
  ENSP ID: ENSP00000486553
MPVAATNSETAMQQVLDNLGSLPSATGAAELDLIFLRGIMESPIVRSLAKVQCSREVGTRALPHLFCFHPQAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 50340 - protein, 585 aa, Homo sapiens
  Payload ID: 10052
  Gene Symbol: MPP3
  Gene Name: membrane protein, palmitoylated 3 (MAGUK p55 subfamily member 3)
  Uniprot ID: Q13368
  ENSP ID: ENSP00000381425
MPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDELREVNGIAVLHKRPDEISQILAQSQGSITLKIIPATQEEDRLKESKVFMRALFHYNPREDRAIPCQEAGLPFQRRQVLEVVSQDDPTWWQAKRVGDTNLRAGLIPSKGFQERRLSYRRAAGTLPSPQSLRKPPYDQPCDKETCDCEGYLKGHYVAGLRRSFRLGCRERLGGSQEGKMSSGAESPELLTYEEVARYQHQPGERPRLVVLIGSLGARLHELKQKVVAENPQHFGVAVPHTTRPRKSHEKEGVEYHFVSKQAFEADLHHNKFLEHGEYKENLYGTSLEAIQAVMAKNKVCLVDVEPEALKQLRTSEFKPYIIFVKPAIQEKRKTPPMSPACEDTAAPFDEQQQEMAASAAFIDRHYGHLVDAVLVKEDLQGAYSQLKVVLEKLSKDTHWVPVSWVR

SEQ ID NO: 50341 - protein, 610 aa, Homo sapiens
  Payload ID: 10052
  Gene Symbol: MPP3
  Gene Name: membrane protein, palmitoylated 3 (MAGUK p55 subfamily member 3)
  ENSP ID: ENSP00000381430
MELQYPPPPPSPRICRERSGGDNASMPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDELREVNGIAVLHKRPDEISQILAQSQGSITLKIIPATQEEDRLKESKVFMRALFHYNPREDRAIPCQEAGLPFQRRQVLEVVSQDDPTWWQAKRVGDTNLRAGLIPSKGFQERRLSYRRAAGTLPSPQSLRKPPYDQPCDKETCDCEGYLKGHYVAGLRRSFRLGCRERLGGSQEGKMSSGAESPELLTYEEVARYQHQPGERPRLVVLIGSLGARLHELKQKVVAENPQHFGVAVPHTTRPRKSHEKEGVEYHFVSKQAFEADLHHNKFLEHGEYKENLYGTSLEAIQAVMAKNKVCLVDVEPEALKQLRTSEFKPYIIFVKPAIQEKRKTPPMSPACEDTAAPFDEQQQEMAASAAFIDRHYGHLVDAVLVKEDLQGAYSQLKVVLEKLSKDTHWVPVSWVR

SEQ ID NO: 50342 - protein, 315 aa, Homo sapiens
  Payload ID: 10052
  Gene Symbol: MPP3
  Gene Name: membrane protein, palmitoylated 3 (MAGUK p55 subfamily member 3)
  ENSP ID: ENSP00000465486
MPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDELREVNGIAVLHKRPDEISQILAQSQGSITLKIIPATQEEDRLKESKVFMRALFHYNPREDRAIPCQEAGLPFQRRQVLEVVSQDDPTWWQAKRVGDTNLRAGLIPSKGFQERRLSYRRAAGTLPSPQSLRKPP

SEQ ID NO: 50343 - protein, 20 aa, Homo sapiens
  Payload ID: 10052
  Gene Symbol: MPP3
  Gene Name: membrane protein, palmitoylated 3 (MAGUK p55 subfamily member 3)
  ENSP ID: ENSP00000467453
GDTNLRAGLIPSKGFQERRF

SEQ ID NO: 50344 - protein, 593 aa, Homo sapiens
  Payload ID: 10053
  Gene Symbol: MPP4
  Gene Name: membrane protein, palmitoylated 4 (MAGUK p55 subfamily member 4)
  Uniprot ID: Q96JB8
  ENSP ID: ENSP00000319363
MIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMDPDIPCMDAGLPFQKGDILQIVDQNDALWWQARKISDPATCAGLVPSNHLLKRKQREFWWSQPYQPHTCLKSTLYKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 50345 - protein, 630 aa, Homo sapiens
  Payload ID: 10053
  Gene Symbol: MPP4
  Gene Name: membrane protein, palmitoylated 4 (MAGUK p55 subfamily member 4)
  ENSP ID: ENSP00000353047
MIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLSISMEEEDDMKIDEKCVEAEELSEDKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 50346 - protein, 562 aa, Homo sapiens
  Payload ID: 10053
  Gene Symbol: MPP4
  Gene Name: membrane protein, palmitoylated 4 (MAGUK p55 subfamily member 4)
  ENSP ID: ENSP00000380095
MIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLYKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 50347 - protein, 434 aa, Homo sapiens
  Payload ID: 10053
  Gene Symbol: MPP4
  Gene Name: membrane protein, palmitoylated 4 (MAGUK p55 subfamily member 4)
  ENSP ID: ENSP00000386580
MHVYSLAEAPAGRMIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLFLGYMCRTCSNFYGRRWSFALVAQAGVQWHYLDSLQPLPPGFKRFSCLSLPRSWDYIEDDMKIDEKCVEAAPAAPLTVIMAQLPNTMCFM

SEQ ID NO: 50348 - protein, 637 aa, Homo sapiens
  Payload ID: 10053
  Gene Symbol: MPP4
  Gene Name: membrane protein, palmitoylated 4 (MAGUK p55 subfamily member 4)
  Uniprot ID: Q96JB8
  ENSP ID: ENSP00000387278
MIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLSISMEEEDDMKIDEKCVEADEETFESEELSEDKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 50349 - protein, 579 aa, Homo sapiens
  Payload ID: 10053
  Gene Symbol: MPP4
  Gene Name: membrane protein, palmitoylated 4 (MAGUK p55 subfamily member 4)
  ENSP ID: ENSP00000387293
MIQSDKGADPPDKKDMKLSTATNPQNGLSQILRLVLQELSLFYGRDVNGVCLLYDLLHSPWLQALLKIYDCLQEFKEKKLVPATPHAQVLSYEALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLYKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 50350 - protein, 630 aa, Homo sapiens; identical to SEQ ID NO: 50345
  Payload ID: 10053
  Gene Symbol: MPP4
  Gene Name: membrane protein, palmitoylated 4 (MAGUK p55 subfamily member 4)
  ENSP ID: ENSP00000406160

SEQ ID NO: 50351 - protein, 613 aa, Homo sapiens
  Payload ID: 10053
  Gene Symbol: MPP4
  Gene Name: membrane protein, palmitoylated 4 (MAGUK p55 subfamily member 4)
  ENSP ID: ENSP00000416781
MIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLYEETFESDKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 50352 - protein, 171 aa, Homo sapiens
  Payload ID: 10053
  Gene Symbol: MPP4
  Gene Name: membrane protein, palmitoylated 4 (MAGUK p55 subfamily member 4)
  ENSP ID: ENSP00000473500
MHVYSLAEAPAGRMIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLV

SEQ ID NO: 50353 - protein, 606 aa, Homo sapiens
  Payload ID: 10053
  Gene Symbol: MPP4
  Gene Name: membrane protein, palmitoylated 4 (MAGUK p55 subfamily member 4)
  ENSP ID: ENSP00000478875
MIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLYKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 50354 - protein, 675 aa, Homo sapiens
  Payload ID: 10054
  Gene Symbol: MPP5
  Gene Name: membrane protein, palmitoylated 5 (MAGUK p55 subfamily member 5)
  Uniprot ID: Q8N3R9
  ENSP ID: ENSP00000261681
MTTSHMNGHVTEESDSEVKNVDLASPEEHQKHREMAVDCPGDLGTRMMPIRRSAQLERIRQQQEDMRRRREEEGKKQELDLNSSMRLKKLAQIPPKTGIDNPMFDTEEGIVLESPHYAVKILEIEDLFSSLKHIQHTLVDSQSQEDISLLLQLVQNKDFQNAFKIHNAITVHMNKASPPFPLISNAQDLAQEVQTVLKPVHHKEGQELTALLNTPHIQALLLAHDKVAEQEMQLEPITDERVYESIGQYGGETVKIVRIEKARDIPLGATVRNEMDSVIISRIVKGGAAEKSGLLHEGDEVLEINGIEIRGKDVNEVFDLLSDMHGTLTFVLIPSQQIKPPPAKETVIHVKAHFDYDPSDDPYVPCRELGLSFQKGDILHVISQEDPNWWQAYREGDEDNQPLAGLVPGKSFQQQREAMKQTIEEDKEPEKSGKLWCAKKNKKKRKKVLYNANKNDDYDNEEILTYEEMSLYHQPANRKRPIILIGPQNCGQNELRQRLMNKEKDRFASAVPHTTRSRRDQEVAGRDYHFVSRQAFEADIAAGKFIEHGEFEKNLYGTSIDSVRQVINSGKICLLSLRTQSLKTLRNSDLKPYIIFIAPPSQERLRALLAKEGKNPKPEELREIIEKTREMEQNNGHYFDTAIVNSDLDKAYQELLRLINKLDTEPQWVPSTWLR

SEQ ID NO: 50355 - protein, 124 aa, Homo sapiens
  Payload ID: 10054
  Gene Symbol: MPP5
  Gene Name: membrane protein, palmitoylated 5 (MAGUK p55 subfamily member 5)
  ENSP ID: ENSP00000450550
MTTSHMNGHVTEESDSEVKNVDLASPEEHQKHREMAVDCPGDLGTRMMPIRRSAQLERIRQQQEDMRRRREEEGKKQELDLNSSMRLKKLAQIPPKTGIDNPMFDTEEGIVLESPHYAVKILGK

SEQ ID NO: 50356 - protein, 149 aa, Homo sapiens
  Payload ID: 10054
  Gene Symbol: MPP5
  Gene Name: membrane protein, palmitoylated 5 (MAGUK p55 subfamily member 5)
  ENSP ID: ENSP00000450656
MAVDCPGDLGTRMMPIRRSAQLERIRQQQEDMRRRREEEGKKQELDLNSSMRLKKLAQIPPKTGIDNPMFDTEEGIVLESPHYAVKILEIEDLFSSLKHIQHTLVDSQSQEDISLLLQLVQNKDFQNAFKIHNAITVHMNKASPPFPLI

SEQ ID NO: 50357 - protein, 641 aa, Homo sapiens
  Payload ID: 10054
  Gene Symbol: MPP5
  Gene Name: membrane protein, palmitoylated 5 (MAGUK p55 subfamily member 5)
  Uniprot ID: Q8N3R9
  ENSP ID: ENSP00000451488
MAVDCPGDLGTRMMPIRRSAQLERIRQQQEDMRRRREEEGKKQELDLNSSMRLKKLAQIPPKTGIDNPMFDTEEGIVLESPHYAVKILEIEDLFSSLKHIQHTLVDSQSQEDISLLLQLVQNKDFQNAFKIHNAITVHMNKASPPFPLISNAQDLAQEVQTVLKPVHHKEGQELTALLNTPHIQALLLAHDKVAEQEMQLEPITDERVYESIGQYGGETVKIVRIEKARDIPLGATVRNEMDSVIISRIVKGGAAEKSGLLHEGDEVLEINGIEIRGKDVNEVFDLLSDMHGTLTFVLIPSQQIKPPPAKETVIHVKAHFDYDPSDDPYVPCRELGLSFQKGDILHVISQEDPNWWQAYREGDEDNQPLAGLVPGKSFQQQREAMKQTIEEDKEPEKSGKLWCAKKNKKKRKKVLYNANKNDDYDNEEILTYEEMSLYHQPANRKRPIILIGPQNCGQNELRQRLMNKEKDRFASAVPHTTRSRRDQEVAGRDYHFVSRQAFEADIAAGKFIEHGEFEKNLYGTSIDSVRQVINSGKICLLSLRTQSLKTLRNSDLKPYIIFIAPPSQERLRALLAKEGKNPKPEELREIIEKTREMEQNNGHYFDTAIVNSDLDKAYQELLRLINKLDTEPQWVPSTWLR

SEQ ID NO: 50358 - protein, 4 aa, Homo sapiens
  Payload ID: 10054
  Gene Symbol: MPP5
  Gene Name: membrane protein, palmitoylated 5 (MAGUK p55 subfamily member 5)
  ENSP ID: ENSP00000451571
MAVD

SEQ ID NO: 50359 - protein, 540 aa, Homo sapiens
  Payload ID: 10055
  Gene Symbol: MPP6
  Gene Name: membrane protein, palmitoylated 6 (MAGUK p55 subfamily member 6)
  Uniprot ID: Q9NZW5
  ENSP ID: ENSP00000222644
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKKKMMYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 50360 - protein, 540 aa, Homo sapiens; identical to SEQ ID NO: 50359
  Payload ID: 10055
  Gene Symbol: MPP6
  Gene Name: membrane protein, palmitoylated 6 (MAGUK p55 subfamily member 6)
  Uniprot ID: Q9NZW5
  ENSP ID: ENSP00000379737

SEQ ID NO: 50361 - protein, 428 aa, Homo sapiens
  Payload ID: 10055
  Gene Symbol: MPP6
  Gene Name: membrane protein, palmitoylated 6 (MAGUK p55 subfamily member 6)
  ENSP ID: ENSP00000386262
MNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKKKMMYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 50362 - protein, 307 aa, Homo sapiens
  Payload ID: 10055
  Gene Symbol: MPP6
  Gene Name: membrane protein, palmitoylated 6 (MAGUK p55 subfamily member 6)
  ENSP ID: ENSP00000391020
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKK

SEQ ID NO: 50363 - protein, 217 aa, Homo sapiens
  Payload ID: 10055
  Gene Symbol: MPP6
  Gene Name: membrane protein, palmitoylated 6 (MAGUK p55 subfamily member 6)
  ENSP ID: ENSP00000395859
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQ

SEQ ID NO: 50364 - protein, 41 aa, Homo sapiens
  Payload ID: 10055
  Gene Symbol: MPP6
  Gene Name: membrane protein, palmitoylated 6 (MAGUK p55 subfamily member 6)
  ENSP ID: ENSP00000400515
MQQVLENLTELPSSTGAEEIDLIFLKGIMENPIVKSLAKGL

SEQ ID NO: 50365 - protein, 64 aa, Homo sapiens
  Payload ID: 10055
  Gene Symbol: MPP6
  Gene Name: membrane protein, palmitoylated 6 (MAGUK p55 subfamily member 6)
  ENSP ID: ENSP00000473560
  MOD_RES (1)..(1): Any amino acid
XSGPFCGTISSKKKKKMMYLTTRNAVAEDDRNKKQLYESEISGGLIKGVGNFKSTFLTSELPLC

SEQ ID NO: 50366 - protein, 41 aa, Homo sapiens; identical to SEQ ID NO: 50364
  Payload ID: 10055
  Gene Symbol: MPP6
  Gene Name: membrane protein, palmitoylated 6 (MAGUK p55 subfamily member 6)
  ENSP ID: ENSP00000487215

SEQ ID NO: 50367 - protein, 576 aa, Homo sapiens
  Payload ID: 10056
  Gene Symbol: MPP7
  Gene Name: membrane protein, palmitoylated 7 (MAGUK p55 subfamily member 7)
  Uniprot ID: Q5T2T1
  ENSP ID: ENSP00000337907
MPALSTGSGSDTGLYELLAALPAQLQPHVDSQEDLTFLWDMFGEKSLHSLVKIHEKLHYYEKQSPVPILHGAAALADDLAEELQNKPLNSEIRELLKLLSKPNVKALLSVHDTVAQKNYDPVLPPMPEDIDDEEDSVKIIRLVKNREPLGATIKKDEQTGAIIVARIMRGGAADRSGLIHVGDELREVNGIPVEDKRPEEIIQILAQSQGAITFKIIPGSKEETPSKEGKMFIKALFDYNPNEDKAIPCKEAGLSFKKGDILQIMSQDDATWWQAKHEADANPRAGLIPSKHFQERRLALRRPEILVQPLKVSNRKSSGFRKSFRLSRKDKKTNKSMYECKKSDQYDTADVPTYEEVTPYRRQTNEKYRLVVLVGPVGVGLNELKRKLLISDTQHYGVTVPHTTRARRSQESDGVEYIFISKHLFETDVQNNKFIEYGEYKNNYYGTSIDSVRSVLAKNKVCLLDVQPHTVKHLRTLEFKPYVIFIKPPSIERLRETRKNAKIISSRDDQGAAKPFTEEDFQEMIKSAQIMESQYGHLFDKIIINDDLTVAFNELKTTFDKLETETHWVPVSWLHS

SEQ ID NO: 50368 - protein, 576 aa, Homo sapiens; identical to SEQ ID NO: 50367
  Payload ID: 10056
  Gene Symbol: MPP7
  Gene Name: membrane protein, palmitoylated 7 (MAGUK p55 subfamily member 7)
  Uniprot ID: Q5T2T1
  ENSP ID: ENSP00000364871

SEQ ID NO: 50369 - protein, 576 aa, Homo sapiens; identical to SEQ ID NO: 50367
  Payload ID: 10056
  Gene Symbol: MPP7
  Gene Name: membrane protein, palmitoylated 7 (MAGUK p55 subfamily member 7)
  Uniprot ID: Q5T2T1
  ENSP ID: ENSP00000364884

SEQ ID NO: 50370 - protein, 312 aa, Homo sapiens
  Payload ID: 10056
  Gene Symbol: MPP7
  Gene Name: membrane protein, palmitoylated 7 (MAGUK p55 subfamily member 7)
  ENSP ID: ENSP00000398319
MPALSTGSGSDTGLYELLAALPAQLQPHVDSQEDLTFLWDMFGEKSLHSLVKHFQERRLALRRPEILVQPLKVSNRKSSGFRKSFRLSRKDKKTNKSMYECKKSDQYDTADVPTYEEVTPYRRQTNEKYRLVVLVGPVGVGLNELKRKLLISDTQHYGVTVPHTTRARRSQESDGVEYIFISKHLFETDVQNNKFIEYGEYKNNYYGTSIDSVRSVLAKNKVCLLDVQPHTVKHLRTLEFKPYVIFIKPPSIERLRETRKNAKIISSRDDQGAAKPFTEEDFQEMIKSAQIMESQYGHLFDKIIINDDLTVA

SEQ ID NO: 50371 - protein, 454 aa, Homo sapiens
  Payload ID: 10056
  Gene Symbol: MPP7
  Gene Name: membrane protein, palmitoylated 7 (MAGUK p55 subfamily member 7)
  ENSP ID: ENSP00000473899
MPALSTGSGSDTGLYELLAALPAQLQPHVDSQEDLTFLWDMFGEKSLHSLVKIHEKLHYYEKQSPVPILHGAAALADDLAEELQNKPLNSEIRELLKLLSKPNVKALLSVHDTVAQKNYDPVLPPMPEDIDDEEDSVKIIRLVKNREPLGATIKKDEQTGAIIVARIMRGGAADRSGLIHVGDELREVNGIPVEDKRPEEIIQILAQSQGAITFKIIPGSKEETPSKEGKMFIKALFDYNPNEDKAIPCKEAGLSFKKGDILQIMSQDDATWWQAKHEADANPRAGLIPSKHFQERRLALRRPEILVQPLKVSNRKSSGFRKSFRLSRKDKKTNKSMYECKKSDQYDTADVPTYEEVTPYRRQTNEKYRLVVLVGPVGVGLNELKRKLLISDTQHYGVTVPHTTRARRSQESDGVEYIFISKHLFETDVQNNKYVDIFENFHVTVFYKHMPVPF

SEQ ID NO: 50372 - protein, 289 aa, Homo sapiens
  Payload ID: 10057
  Gene Symbol: MARCH1
  Gene Name: membrane-associated ring finger (C3HC4) 1, E3 ubiquitin protein ligase
  Uniprot ID: Q8TCQ1
  ENSP ID: ENSP00000274056
MLGWCEAIARNPHRIPNNTRTPEISGDLADASQTSTLNEKSPGRSASRSSNISKASSPTTGTAPRSQSRLSVCPSTQDICRICHCEGDEESPLITPCRCTGTLRFVHQSCLHQWIKSSDTRCCELCKYDFIMETKLKPLRKWEKLQMTTSERRKIFCSVTFHVIAITCVVWSLYVLIDRTAEEIKQGNDNGVLEWPFWTKLVVVAIGFTGGLVFMYVQCKVYVQLWRRLKAYNRVIFVQNCPDTAKKLEKNFSCNVNTDIKDAVVVPVPQTGANSLPSAEGGPPEVVSV

SEQ ID NO: 50373 - protein, 272 aa, Homo sapiens
  Payload ID: 10057
  Gene Symbol: MARCH1
  Gene Name: membrane-associated ring finger (C3HC4) 1, E3 ubiquitin protein ligase
  Uniprot ID: Q8TCQ1
  ENSP ID: ENSP00000345676
MTSSHVCCNFLNMWKKSKISTMYYLNQDAKLSNLFLQASSPTTGTAPRSQSRLSVCPSTQDICRICHCEGDEESPLITPCRCTGTLRFVHQSCLHQWIKSSDTRCCELCKYDFIMETKLKPLRKWEKLQMTTSERRKIFCSVTFHVIAITCVVWSLYVLIDRTAEEIKQGNDNGVLEWPFWTKLVVVAIGFTGGLVFMYVQCKVYVQLWRRLKAYNRVIFVQNCPDTAKKLEKNFSCNVNTDIKDAVVVPVPQTGANSLPSAEGGPPEVVSV

SEQ ID NO: 50374 - protein, 545 aa, Homo sapiens
  Payload ID: 10057
  Gene Symbol: MARCH1
  Gene Name: membrane-associated ring finger (C3HC4) 1, E3 ubiquitin protein ligase
  ENSP ID: ENSP00000421322
MLGWCEAIARNPHRIPNNTRTPEISGDLADASQTSTLNEKSPGRSASRSSNISKASSPTTGTAPRSQSRLSVCPSTQDICRSAILHDMSEESFEYCTPVMVLSPARKESGKKSVIQRPRRRRKASERYEHAAEEQIRGRKNDFHLQISSPRWRELYTDSSDSSSTDESHWIQAKRRAQVKFRLSRRRRRNNNKPCENLAGSSTPNGIELVDLGSKGKEQQELIECESCSLNLHRGKHTRYQECNPSLTQGSSEIKRSSRNHEKSKGRYHHRDPQLLQSLRKNEIMKKTFSETDSSTEILGVPEGSKDMNDAGLQVNNPVQKPPATYDDGSDNLEVCRICHCEGDEESPLITPCRCTGTLRFVHQSCLHQWIKSSDTRCCELCKYDFIMETKLKPLRKWEKLQMTTSERRKIFCSVTFHVIAITCVVWSLYVLIDRTAEEIKQGNDNGVLEWPFWTKLVVVAIGFTGGLVFMYVQCKVYVQLWRRLKAYNRVIFVQNCPDTAKKLEKNFSCNVNTDIKDAVVVPVPQTGANSLPSAEGGPPEVVSV

SEQ ID NO: 50375 - protein, 144 aa, Homo sapiens
  Payload ID: 10057
  Gene Symbol: MARCH1
  Gene Name: membrane-associated ring finger (C3HC4) 1, E3 ubiquitin protein ligase
  ENSP ID: ENSP00000424089
MTSSHVCCNFLNMWKKSKISTMYYLNQDAKLSNLFLQASSPTTGTAPRSQSRLSVCPSTQDICRICHCEGDEESPLITPCRCTGTLRFVHQSCLHQWIKSSDTRCCELCKYDFIMETKLKPLRKCLCFCLVHEHCLLNGKAMIT

SEQ ID NO: 50376 - protein, 141 aa, Homo sapiens
  Payload ID: 10057
  Gene Symbol: MARCH1
  Gene Name: membrane-associated ring finger (C3HC4) 1, E3 ubiquitin protein ligase
  ENSP ID: ENSP00000426731
MLGWCEAIARNPHRIPNNTRTPEISGDLADASQTSTLNEKSPGRSASRSSNISKASSPTTGTAPRSQSRLSVCPSTQDICRICHCEGDEESPLITPCRCTGTLRFVHQSCLHQWIKSSDTRCCELCKYDFIMETKLKPLRK

SEQ ID NO: 50377 - protein, 289 aa, Homo sapiens; identical to SEQ ID NO: 50372
  Payload ID: 10057
  Gene Symbol: MARCH1
  Gene Name: membrane-associated ring finger (C3HC4) 1, E3 ubiquitin protein ligase
  Uniprot ID: Q8TCQ1
  ENSP ID: ENSP00000427223

SEQ ID NO: 50378 - protein, 808 aa, Homo sapiens
  Payload ID: 10058
  Gene Symbol: MARCH10
  Gene Name: membrane-associated ring finger (C3HC4) 10, E3 ubiquitin protein ligase
  Uniprot ID: Q8NA82
  ENSP ID: ENSP00000311496
MLHDARDRQKFFSDVQYLRDMQHKVDSEYQACLRRQEYRRDPNEKKRDQFWGQETSFERSRFSSRSSSKQSSSEEDALTEPRSSIKISAFKCDSKLPAIDQTSVKQKHKSTMTVRKAEKVDPSEPSPADQAPMVLLRKRKPNLRRFTVSPESHSPRASGDRSRQKQQWPAKVPVPRGADQVVQQEGLMCNTKLKRPNQERRNLVPSSQPMTENAPDRAKKGDPSAPSQSELHPALSQAFQGKNSPQVLSEFSGPPLTPTTVGGPRKASFRFRDEDFYSILSLNSRRESDDTEEETQSEECLWVGVRSPCSPSHHKRSRFGGTSTPQAKNKNFEENAENCRGHSSRRSEPSHGSLRISNAMEPATERPSAGQRLSQDPGLPDRESATEKDRGGSENAKKSPLSWDTKSEPRQEVGVNAENVWSDCISVEHRPGTHDSEGYWKDYLNSSQNSLDYFISGRPISPRSSVNSSYNPPASFMHSALRDDIPVDLSMSSTSVHSSDSEGNSGFHVCQPLSPIRNRTPFASAENHNYFPVNSAHEFAVREAEDTTLTSQPQGAPLYTDLLLNPQGNLSLVDSSSSSPSRMNSEGHLHVSGSLQENTPFTFFAVSHFPNQNDNGSRMAASGFTDEKETSKIKADPEKLKKLQESLLEEDSEEEGDLCRICQIAGGSPSNPLLEPCGCVGSLQFVHQECLKKWLKVKITSGADLGAVKTCEMCKQGLLVDLGDFNMIEFYQKHQQSQAQNELMNSGLYLVLLLHLYEQRFAELMRLNHNQVERERLSRNYPQPRTEENENSELGDGNEGSISQSQVV

SEQ ID NO: 50379 - protein, 808 aa, Homo sapiens; identical to SEQ ID NO: 50378
  Payload ID: 10058
  Gene Symbol: MARCH10
  Gene Name: membrane-associated ring finger (C3HC4) 10, E3 ubiquitin protein ligase
  Uniprot ID: Q8NA82
  ENSP ID: ENSP00000416177

SEQ ID NO: 50380 - protein, 799 aa, Homo sapiens
  Payload ID: 10058
  Gene Symbol: MARCH10
  Gene Name: membrane-associated ring finger (C3HC4) 10, E3 ubiquitin protein ligase
  ENSP ID: ENSP00000443746
MLHDARDRQKFFSDVQYLRDMQHKVDSEYQACLRRQEYRRDPNEKKRDQFWGQETSFERSRFSSRSSSKQSSSEEDALTEPRSSIKISAFKCDSKLPAIDQTSVKQKHKSTMTVRKAEKVDPSEPSPDQAPMVLLRKRKPNLRRFTVSPESHSPRASGDRSRQKQQWPAKVPVPRGADQVVQQEGLMCNTKLKRPNQERRNLVPSSQPMTENAPDRAKKGDPSAPSQSELHPALSQAFQGKNSPQVLSEFSGPPLTPTTVGGPRKASFRFRDEDFYSILSLNSRRESDDTEEETQSEECLWVGVRSPCSPSHHKRSRFGGTSTPQAKNKNFEENAENCRGHSSRRSEPSHGSLRISNAMEPATERPSAGQRLSQDPGLPDRESATEKDRGGSENAKKSPLSWDTKSEPRQEVGVNAENVWSDCISVEHRPGTHDSEGYWKDYLNSSQNSLDYFISGRPISPRSSVNSSYNPPASFMHSALRDDIPVDLSMSSTSVHSSDSEGNSGFHVCQPLSPIRNRTPFASAENHNYFPVNSAHEFAVREAEDTTLTSQPQGAPLYTDLLLNPQGNLSLVDSSSSSPSRMNSEGHLHVSGSLQENTPFTFFAVSHFPNQNDNGSRMAASGFTDEKETSKIKADPEKLKKLQESLLEEDSEEEGDLCRICQIAGGSPSNPLLEPCGCVGSLQFVHQECLKKWLKVKITSGADLGAVKTCEMCKQGLLVDLGDFNMIEFYQKHQQSQAQNELMNSGLYLVLLLHLYEQRFAELMRLNHNQVERERLSRNYPQPRTEENESRFWGPVLPF

SEQ ID NO: 50381 - protein, 61 aa, Homo sapiens
  Payload ID: 10058
  Gene Symbol: MARCH10
  Gene Name: membrane-associated ring finger (C3HC4) 10, E3 ubiquitin protein ligase
  ENSP ID: ENSP00000463029
MLHDARDRQKFFSDVQYLRDMQHKVDSEYQACLRRQEYRRDPNEKKRDQFWGQETSFERSR

SEQ ID NO: 50382 - protein, 846 aa, Homo sapiens
  Payload ID: 10058
  Gene Symbol: MARCH10
  Gene Name: membrane-associated ring finger (C3HC4) 10, E3 ubiquitin protein ligase
  ENSP ID: ENSP00000463080
MLHDARDRQKFFSDVQYLRDMQHKVDSEYQACLRRQEYRRDPNEKKRDQFWGQETSFERSRFSSRSSSKQSSSEEDALTEPRSSIKISAFKCDSKLPAIDQTSVKQKHKSTMTVRKAEKVDPSEPSPAESEPTWWNKPETDLGGPSGWCSLGKKGPMSRSIPPCEADQAPMVLLRKRKPNLRRFTVSPESHSPRASGDRSRQKQQWPAKVPVPRGADQVVQQEGLMCNTKLKRPNQERRNLVPSSQPMTENAPDRAKKGDPSAPSQSELHPALSQAFQGKNSPQVLSEFSGPPLTPTTVGGPRKASFRFRDEDFYSILSLNSRRESDDTEEETQSEECLWVGVRSPCSPSHHKRSRFGGTSTPQAKNKNFEENAENCRGHSSRRSEPSHGSLRISNAMEPATERPSAGQRLSQDPGLPDRESATEKDRGGSENAKKSPLSWDTKSEPRQEVGVNAENVWSDCISVEHRPGTHDSEGYWKDYLNSSQNSLDYFISGRPISPRSSVNSSYNPPASFMHSALRDDIPVDLSMSSTSVHSSDSEGNSGFHVCQPLSPIRNRTPFASAENHNYFPVNSAHEFAVREAEDTTLTSQPQGAPLYTDLLLNPQGNLSLVDSSSSSPSRMNSEGHLHVSGSLQENTPFTFFAVSHFPNQNDNGSRMAASGFTDEKETSKIKADPEKLKKLQESLLEEDSEEEGDLCRICQIAGGSPSNPLLEPCGCVGSLQFVHQECLKKWLKVKITSGADLGAVKTCEMCKQGLLVDLGDFNMIEFYQKHQQSQAQNELMNSGLYLVLLLHLYEQRFAELMRLNHNQVERERLSRNYPQPRTEENENSELGDGNEGSISQSQVV

SEQ ID NO: 50383 - protein, 164 aa, Homo sapiens
  Payload ID: 10058
  Gene Symbol: MARCH10
  Gene Name: membrane-associated ring finger (C3HC4) 10, E3 ubiquitin protein ligase
  ENSP ID: ENSP00000463572
DALTEPRSSIKISAFKCDSKLPAIDQTSVKQKHKSTMTVRKAEKVDPSEPSPGGSSKHPLFCVEYTPYCSVFAFSPVLQPNTNYCCLLLPLVPPASPVAQEPPDCPLPLVTVPSFTSTASTSPDPVPESPAVLCYFPISCPTPAETPVLCLQGPRRPSRIYLMW

SEQ ID NO: 50384 - protein, 693 aa, Homo sapiens
  Payload ID: 10058
  Gene Symbol: MARCH10
  Gene Name: membrane-associated ring finger (C3HC4) 10, E3 ubiquitin protein ligase
  ENSP ID: ENSP00000464220
MVLLRKRKPNLRRFTVSPESHSPRASGDRSRQKQQWPAKVPVPRGADQVVQQEGLMCNTKLKRPNQERRNLVPSSQPMTENAPDRAKKGDPSAPSQSELHPALSQAFQGKNSPQVLSEFSGPPLTPTTVGGPRKASFRFRDEDFYSILSLNSRRESDDTEEETQSEECLWVGVRSPCSPSHHKRSRFGGTSTPQAKNKNFEENAENCRGHSSRRSEPSHGSLRISNAMEPATERPSAGQRLSQDPGLPDRESATEKDRGGSENAKKSPLSWDTKSEPRQEVGVNAENVWSDCISVEHRPGTHDSEGYWKDYLNSSQNSLDYFISGRPISPRSSVNSSYNPPASFMHSALRDDIPVDLSMSSTSVHSSDSEGNSGFHVCQPLSPIRNRTPFASAENHNYFPVNSAHEFAVREAEDTTLTSQPQGAPLYTDLLLNPQGNLSLVDSSSSSPSRMNSEGHLHVSGSLQENTPFTFFAVSHFPNQNDNGSRMAASGFTDEKETSKIKADPEKLKKLQESLLEEDSEEEGDLCRICQIAGGSPSNPLLEPCGCVGSLQFVHQECLKKWLKVKITSGADLGAVKTCEMCKQGLLVDLGDFNMIEFYQKHQQSQAQNELMNSGLYLVLLLHLYEQRFAELMRLNHNQVERERIRSWEMEMKAAFLKARSSSKEANCGARRRPLPPALLSTSPSASLPPPLY

SEQ ID NO: 50385 - protein, 402 aa, Homo sapiens
  Payload ID: 10059
  Gene Symbol: MARCH11
  Gene Name: membrane-associated ring finger (C3HC4) 11
  Uniprot ID: A6NNE9
  ENSP ID: ENSP00000333181
MSFEGGHGGSRCRGAESGDAEPPPQPPPPPPPTPPPGEPAPVPAAPRYLPPLPASPETPERAAGPSEPLGEVAPRCRGADELPPPPLPLQPAGQEVAAAGDSGEGPRRLPEAAAAKGGPGESEAGAGGERERRGAGDQPETRSVCSSRSSSSGGGDQRAGHQHQHHQPICKICFQGAEQGELLNPCRCDGSVRYTHQLCLLKWISERGSWTCELCCYRYHVIAIKMKQPCQWQSISITLVEKVQMIAVILGSLFLIASVTWLLWSAFSPYAVWQRKDILFQICYGMYGFMDLVCIGLIVHEGAAVYRVFKRWRAVNLHWDVLNYDKATDIEESSRGESSTSRTLWLPLTALRNRNLVHPTQLTSPRFQCGYVLLHLFNRMRPHEDLSEDNSSGEVVMRVTSV

SEQ ID NO: 50386 - protein, 54 aa, Homo sapiens
  Payload ID: 10059
  Gene Symbol: MARCH11
  Gene Name: membrane-associated ring finger (C3HC4) 11
  ENSP ID: ENSP00000424425
  MOD_RES (1)..(1): Any amino acid
XLCLLKWISERGSWTCELCCYRYHVIAIKMKQPCQVSLFMKELQFTECLSAGEL

SEQ ID NO: 50387 - protein, 246 aa, Homo sapiens
  Payload ID: 10060
  Gene Symbol: MARCH2
  Gene Name: membrane-associated ring finger (C3HC4) 2, E3 ubiquitin protein ligase
  Uniprot ID: Q9P0N8
  ENSP ID: ENSP00000215555
MTTGDCCHLPGSLCDCSGSPAFSKVVEATGLGPPQYVAQVTSRDGRLLSTVIRALDTPSDGPFCRICHEGANGECLLSPCGCTGTLGAVHKSCLEKWLSSSNTSYCELCHTEFAVEKRPRPLTEWLKDPGPRTEKRTLCCDMVCFLFITPLAAISGWLCLRGAQDHLRLHSQLEAVGLIALTIALFTIYVLWTLVSFRYHCQLYSEWRKTNQKVRLKIREADSPEGPQHSPLAAGLLKKVAEETPV

SEQ ID NO: 50388 - protein, 176 aa, Homo sapiens
  Payload ID: 10060
  Gene Symbol: MARCH2
  Gene Name: membrane-associated ring finger (C3HC4) 2, E3 ubiquitin protein ligase
  Uniprot ID: Q9P0N8
  ENSP ID: ENSP00000370423
MTTGDCCHLPGSLCDCSGSPAFSKVVEATGLGPPQYVAQVTSRDGRLLSTVIRALDTPSDGPFCRICHEGANGECLLSPCGCTGTLGAVHKSCLEKWLSSSNTSYCELCHTEFAVEKRPRPLTEVSFRYHCQLYSEWRKTNQKVRLKIREADSPEGPQHSPLAAGLLKKVAEETPV

SEQ ID NO: 50389 - protein, 40 aa, Homo sapiens
  Payload ID: 10060
  Gene Symbol: MARCH2
  Gene Name: membrane-associated ring finger (C3HC4) 2, E3 ubiquitin protein ligase
  ENSP ID: ENSP00000469386
MTTGDCCHLPGSLCDCSGSPAFSKVVEATGLGPPQYVTPV

SEQ ID NO: 50390 - protein, 56 aa, Homo sapiens
  Payload ID: 10060
  Gene Symbol: MARCH2
  Gene Name: membrane-associated ring finger (C3HC4) 2, E3 ubiquitin protein ligase
  ENSP ID: ENSP00000471411
MTTGDCCHLPGSLCDCSGSPAFSKVVEATGLGPPQYVAQVTSRDGRLLSTVIRALD

SEQ ID NO: 50391 - protein, 246 aa, Homo sapiens; identical to SEQ ID NO: 50387
  Payload ID: 10060
  Gene Symbol: MARCH2
  Gene Name: membrane-associated ring finger (C3HC4) 2, E3 ubiquitin protein ligase
  Uniprot ID: Q9P0N8
  ENSP ID: ENSP00000471536

SEQ ID NO: 50392 - protein, 80 aa, Homo sapiens
  Payload ID: 10060
  Gene Symbol: MARCH2
  Gene Name: membrane-associated ring finger (C3HC4) 2, E3 ubiquitin protein ligase
  ENSP ID: ENSP00000471619
MTTGDCCHLPGSLCDCSGSPAFSKVVEATGLGPPQYVAQVTSRDGRLLSTVIRALDTPSDGPFCRICHEGANGECLLSPC

SEQ ID NO: 50393 - protein, 78 aa, Homo sapiens
  Payload ID: 10060
  Gene Symbol: MARCH2
  Gene Name: membrane-associated ring finger (C3HC4) 2, E3 ubiquitin protein ligase
  ENSP ID: ENSP00000472027
MTTGDCCHLPGSLCDCSGSPAFSKVVEATGLGPPQYVAQVTSRDGRLLSTVIRALDTPSDGPFCRICHEGANGECLLS

SEQ ID NO: 50394 - protein, 253 aa, Homo sapiens
  Payload ID: 10061
  Gene Symbol: MARCH3
  Gene Name: membrane-associated ring finger (C3HC4) 3, E3 ubiquitin protein ligase
  Uniprot ID: Q86UD3
  ENSP ID: ENSP00000309141
MTTSRCSHLPEVLPDCTSSAAPVVKTVEDCGSLVNGQPQYVMQVSAKDGQLLSTVVRTLATQSPFNDRPMCRICHEGSSQEDLLSPCECTGTLGTIHRSCLEHWLSSSNTSYCELCHFRFAVERKPRPLVEWLRNPGPQHEKRTLFGDMVCFLFITPLATISGWLCLRGAVDHLHFSSRLEAVGLIALTVALFTIYLFWTLVSFRYHCRLYNEWRRTNQRVILLIPKSVNVPSNQPSLLGLHSVKRNSKETVV

SEQ ID NO: 50395 - protein, 138 aa, Homo sapiens
  Payload ID: 10061
  Gene Symbol: MARCH3
  Gene Name: membrane-associated ring finger (C3HC4) 3, E3 ubiquitin protein ligase
  Uniprot ID: Q86UD3
  ENSP ID: ENSP00000421979
MTTSRCSHLPEVLPDCTSSAAPVVKTVEDCGSLVNGQPQYVMQVSAKDGQLLSTVVRTLATQSPFNDRPMCRICHEGSSQEDLLSPCECTGTLGTIHRSCLEHWLSSSNTSYCELCHFRFAVERKPRPLVEVSKWGTS

SEQ ID NO: 50396 - protein, 410 aa, Homo sapiens
  Payload ID: 10062
  Gene Symbol: MARCH4
  Gene Name: membrane-associated ring finger (C3HC4) 4, E3 ubiquitin protein ligase
  Uniprot ID: Q9P2E8
  ENSP ID: ENSP00000273067
MLMPLCGLLWWWWCCCSGWYCYGLCAPAPQMLRHQGLLKCRCRMLFNDLKVFLLRRPPQAPLPMHGDPQPPGLAANNTLPALGAGGWAGWRGPREVVGREPPPVPPPPPLPPSSVEDDWGGPATEPPASLLSSASSDDFCKEKTEDRYSLGSSLDSGMRTPLCRICFQGPEQGELLSPCRCDGSVKCTHQPCLIKWISERGCWSCELCYYKYHVIAISTKNPLQWQAISLTVIEKVQVAAAILGSLFLIASISWLIWSTFSPSARWQRQDLLFQICYGMYGFMDVVCIGLIIHEGPSVYRIFKRWQAVNQQWKVLNYDKTKDLEDQKAGGRTNPRTSSSTQANIPSSEEETAGTPAPEQGPAQAAGHPSGPLSHHHCAYTILHILSHLRPHEQRSPPGSSRELVMRVTTV

SEQ ID NO: 50397 - protein, 278 aa, Homo sapiens
  Payload ID: 10063
  Gene Symbol: MARCH5
  Gene Name: membrane-associated ring finger (C3HC4) 5
  Uniprot ID: Q9NX47
  ENSP ID: ENSP00000351813
MPDQALQQMLDRSCWVCFATDEDDRTAEWVRPCRCRGSTKWVHQACLQRWVDEKQRGNSTARVACPQCNAEYLIVFPKLGPVVYVLDLADRLISKACPFAAAGIMVGSIYWTAVTYGAVTVMQVVGHKEGLDVMERADPLFLLIGLPTIPVMLILGKMIRWEDYVLRLWRKYSNKLQILNSIFPGIGCPVPRIPAEANPLADHVSATRILCGALVFPTIATIVGKLMFSSVNSNLQRTILGGIAFVAIKGAFKVYFKQQQYLRQAHRKILNYPEQEEA

SEQ ID NO: 50398 - protein, 910 aa, Homo sapiens
  Payload ID: 10064
  Gene Symbol: MARCH6
  Gene Name: membrane-associated ring finger (C3HC4) 6, E3 ubiquitin protein ligase
  Uniprot ID: O60337
  ENSP ID: ENSP00000274140
MDTAEEDICRVCRSEGTPEKPLYHPCVCTGSIKFIHQECLVQWLKHSRKEYCELCKHRFAFTPIYSPDMPSRLPIQDIFAGLVTSIGTAIRYWFHYTLVAFAWLGVVPLTACRIYKCLFTGSVSSLLTLPLDMLSTENLLADCLQGCFVVTCTLCAFISLVWLREQIVHGGAPIWLEHAAPPFNAAGHHQNEAPAGGNGAENVAADQPANPPAENAVVGENPDAQDDQAEEEEEDNEEEDDAGVEDAADANNGAQDDMNWNALEWDRAAEELTWERMLGLDGSLVFLEHVFWVVSLNTLFILVFAFCPYHIGHFSLVGLGFEEHVQASHFEGLITTIVGYILLAITLIICHGLATLVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTRQWLKGLVRAWTVTAGYLLDLHSYLLGDQEENENSANQQVNNNQHARNNNAIPVVGEGLHAAHQAILQQGGPVGFQPYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 50399 - protein, 862 aa, Homo sapiens
  Payload ID: 10064
  Gene Symbol: MARCH6
  Gene Name: membrane-associated ring finger (C3HC4) 6, E3 ubiquitin protein ligase
  Uniprot ID: O60337
  ENSP ID: ENSP00000414643
MDTAEEDICRVCRSEGTPEKPLYHPCVCTGSIKFIHQECLVQWLKHSRKEYCELCKHRFAFTPSRIYKCLFTGSVSSLLTLPLDMLSTENLLADCLQGCFVVTCTLCAFISLVWLREQIVHGGAPIWLEHAAPPFNAAGHHQNEAPAGGNGAENVAADQPANPPAENAVVGENPDAQDDQAEEEEEDNEEEDDAGVEDAADANNGAQDDMNWNALEWDRAAEELTWERMLGLDGSLVFLEHVFWVVSLNTLFILVFAFCPYHIGHFSLVGLGFEEHVQASHFEGLITTIVGYILLAITLIICHGLATLVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTRQWLKGLVRAWTVTAGYLLDLHSYLLGDQEENENSANQQVNNNQHARNNNAIPVVGEGLHAAHQAILQQGGPVGFQPYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 50400 - protein, 608 aa, Homo sapiens
  Payload ID: 10064
  Gene Symbol: MARCH6
  Gene Name: membrane-associated ring finger (C3HC4) 6, E3 ubiquitin protein ligase
  ENSP ID: ENSP00000424512
MGKPGCRTCCKIKFYLLFSYFQVQASHFEGLITTIVGYILLAITLIICHGLATLVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTRQWLKGLVRAWTVTAGYLLDLHSYLLGDQEENENSANQQVNNNQHARNNNAIPVVGEGLHAAHQAILQQGGPVGFQPYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 50401 - protein, 805 aa, Homo sapiens
  Payload ID: 10064
  Gene Symbol: MARCH6
  Gene Name: membrane-associated ring finger (C3HC4) 6, E3 ubiquitin protein ligase
  Uniprot ID: O60337
  ENSP ID: ENSP00000425930
MDTAEEGRIYKCLFTGSVSSLLTLPLDMLSTENLLADCLQGCFVVTCTLCAFISLVWLREQIVHGGAPIWLEHAAPPFNAAGHHQNEAPAGGNGAENVAADQPANPPAENAVVGENPDAQDDQAEEEEEDNEEEDDAGVEDAADANNGAQDDMNWNALEWDRAAEELTWERMLGLDGSLVFLEHVFWVVSLNTLFILVFAFCPYHIGHFSLVGLGFEEHVQASHFEGLITTIVGYILLAITLIICHGLATLVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTRQWLKGLVRAWTVTAGYLLDLHSYLLGDQEENENSANQQVNNNQHARNNNAIPVVGEGLHAAHQAILQQGGPVGFQPYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 50402 - protein, 77 aa, Homo sapiens
  Payload ID: 10064
  Gene Symbol: MARCH6
  Gene Name: membrane-associated ring finger (C3HC4) 6, E3 ubiquitin protein ligase
  ENSP ID: ENSP00000426000
MDTAEEDICRVCRSEGTPEKPLYHPCVCTGSIKFIHQECLVQWLKHSRKEYCELCKHRFAFTPRKICWQIVCRVVLW

SEQ ID NO: 50403 - protein, 704 aa, Homo sapiens
  Payload ID: 10065
  Gene Symbol: MARCH7
  Gene Name: membrane-associated ring finger (C3HC4) 7, E3 ubiquitin protein ligase
  Uniprot ID: Q9H992
  ENSP ID: ENSP00000259050
MESKPSRIPRRISVQPSSSLSARMMSGSRGSSLNDTYHSRDSSFRLDSEYQSTSASASASPFQSAWYSESEITQGARSRSQNQQRDHDSKRPKLSCTNCTTSAGRNVGNGLNTLSDSSWRHSQVPRSSSMVLGSFGTDLMRERRDLERRTDSSISNLMDYSHRSGDFTTSSYVQDRVPSYSQGARPKENSMSTLQLNTSSTNHQLPSEHQTILSSRDSRNSLRSNFSSRESESSRSNTQPGFSYSSSRDEAPIISNSERVVSSQRPFQESSDNEGRRTTRRLLSRIASSMSSTFFSRRSSQDSLNTRSLNSENSYVSPRILTASQSRSNVPSASEVPDNRASEASQGFRFLRRRWGLSSLSHNHSSESDSENFNQESEGRNTGPWLSSSLRNRCTPLFSRRRREGRDESSRIPTSDTSSRSHIFRRESNEVVHLEAQNDPLGAAANRPQASAASSSATTGGSTSDSAQGGRNTGISGILPGSLFRFAVPPALGSNLTDNVMITVDIIPSGWNSADGKSDKTKSAPSRDPERLQKIKESLLLEDSEEEEGDLCRICQMAAASSSNLLIEPCKCTGSLQYVHQDCMKKWLQAKINSGSSLEAVTTCELCKEKLELNLEDFDIHELHRAHANEQAEYEFISSGLYLVVLLHLCEQSFSDMMGNTNEPSTRVRFINLARTLQAHMEDLETSEDDSEEDGDHNRTFDIA

SEQ ID NO: 50404 - protein, 704 aa, Homo sapiens; identical to SEQ ID NO: 50403
  Payload ID: 10065
  Gene Symbol: MARCH7
  Gene Name: membrane-associated ring finger (C3HC4) 7, E3 ubiquitin protein ligase
  Uniprot ID: Q9H992
  ENSP ID: ENSP00000386830

SEQ ID NO: 50405 - protein, 666 aa, Homo sapiens
  Payload ID: 10065
  Gene Symbol: MARCH7
  Gene Name: membrane-associated ring finger (C3HC4) 7, E3 ubiquitin protein ligase
  Uniprot ID: Q9H992
  ENSP ID: ENSP00000387238
MIGNYDHLMSLVTSTSASASASPFQSAWYSESEITQGARSRSQNQQRDHDSKRPKLSCTNCTTSAGRNVGNGLNTLSDSSWRHSQVPRSSSMVLGSFGTDLMRERRDLERRTDSSISNLMDYSHRSGDFTTSSYVQDRVPSYSQGARPKENSMSTLQLNTSSTNHQLPSEHQTILSSRDSRNSLRSNFSSRESESSRSNTQPGFSYSSSRDEAPIISNSERVVSSQRPFQESSDNEGRRTTRRLLSRIASSMSSTFFSRRSSQDSLNTRSLNSENSYVSPRILTASQSRSNVPSASEVPDNRASEASQGFRFLRRRWGLSSLSHNHSSESDSENFNQESEGRNTGPWLSSSLRNRCTPLFSRRRREGRDESSRIPTSDTSSRSHIFRRESNEVVHLEAQNDPLGAAANRPQASAASSSATTGGSTSDSAQGGRNTGISGILPGSLFRFAVPPALGSNLTDNVMITVDIIPSGWNSADGKSDKTKSAPSRDPERLQKIKESLLLEDSEEEEGDLCRICQMAAASSSNLLIEPCKCTGSLQYVHQDCMKKWLQAKINSGSSLEAVTTCELCKEKLELNLEDFDIHELHRAHANEQAEYEFISSGLYLVVLLHLCEQSFSDMMGNTNEPSTRVRFINLARTLQAHMEDLETSEDDSEEDGDHNRTFDIA

SEQ ID NO: 50406 - protein, 124 aa, Homo sapiens
  Payload ID: 10065
  Gene Symbol: MARCH7
  Gene Name: membrane-associated ring finger (C3HC4) 7, E3 ubiquitin protein ligase
  ENSP ID: ENSP00000391493
EPCKCTGSLQYVHQDCMKKWLQAKINSGSSLEAVTTCELCKEKLELNLEDFDIHELHRAHANEQAEYEFISSGLYLVVLLHLCEQSFSDMMGNTNEPSTRVRLQRMIPKKTETITGHLILPNFI

SEQ ID NO: 50407 - protein, 101 aa, Homo sapiens
  Payload ID: 10065
  Gene Symbol: MARCH7
  Gene Name: membrane-associated ring finger (C3HC4) 7, E3 ubiquitin protein ligase
  ENSP ID: ENSP00000392862
MESKPSRIPRRISVQPSSSLSARMMSGSRGSSLNDTYHSRDSSFRLDSEYQSTSASASASPFQSAWYSESEITQGARSRSQNQQRDHDSKRPKLSCTNCTT

SEQ ID NO: 50408 - protein, 635 aa, Homo sapiens
  Payload ID: 10065
  Gene Symbol: MARCH7
  Gene Name: membrane-associated ring finger (C3HC4) 7, E3 ubiquitin protein ligase
  ENSP ID: ENSP00000442992
MESKPSRIPRRISVQPSSSLSARMMSGSRGSSLNDTYHSRDSSFRLDSEYQSTSASASASPFQSAWYSESEITQGARSRSQNQQRDHDSKRPKLSCTNCTTSAGRNVGNGLNTLSDVQDRVPSYSQGARPKENSMSTLQLNTSSTNHQLPSEHQTILSSRDSRNSLRSNFSSRESESSRSNTQPGFSYSSSRDEAPIISNSERVVSSQRPFQESSDNEGRRTTRRLLSRIASSMSSTFFSRRSSQDSLNTRSLNSENSYVSPRILTASQSRSNVPSASEVPDNRASEASQGFRFLRRRWGLSSLSHNHSSESDSENFNQESEGRNTGPWLSSSLRNRCTPLFSRRRREGRDESSRIPTSDTSSRSHIFRRESNEVVHLEAQNDPLGAAANRPQASAASSSATTGGSTSDSAQGGRNTGISGILPGSLFRFAVPPALGSNLTDNVMITVDIIPSGWNSADGKSDKTKSAPSRDPERLQKIKESLLLEDSEEEEGDLCRICQMAAASSSNLLIEPCKCTGSLQYVHQDCMKKWLQAKINSGSSLEAVTTCELCKEKLELNLEDFDIHELHRAHANEQAEYEFISSGLYLVVLLHLCEQSFSDMMGNTNEPSTRVRLQRMIPKKTETITGHLILPNFI

SEQ ID NO: 50409 - protein, 291 aa, Homo sapiens
  Payload ID: 10066
  Gene Symbol: MARCH8
  Gene Name: membrane-associated ring finger (C3HC4) 8, E3 ubiquitin protein ligase
  Uniprot ID: Q5T0T0
  ENSP ID: ENSP00000317087
MSMPLHQISAIPSQDAISARVYRSKTKEKEREEQNEKTLGHFMSHSSNISKAGSPPSASAPAPVSSFSRTSITPSSQDICRICHCEGDDESPLITPCHCTGSLHFVHQACLQQWIKSSDTRCCELCKYEFIMETKLKPLRKWEKLQMTSSERRKIMCSVTFHVIAITCVVWSLYVLIDRTAEEIKQGQATGILEWPFWTKLVVVAIGFTGGLLFMYVQCKVYVQLWKRLKAYNRVIYVQNCPETSKKNIFEKSPLTEPNFENKHGYGICHSDTNSSCCTEPEDTGAEIIHV

SEQ ID NO: 50410 - protein, 291 aa, Homo sapiens; identical to SEQ ID NO: 50409
  Payload ID: 10066
  Gene Symbol: MARCH8
  Gene Name: membrane-associated ring finger (C3HC4) 8, E3 ubiquitin protein ligase
  Uniprot ID: Q5T0T0
  ENSP ID: ENSP00000379116

SEQ ID NO: 50411 - protein, 240 aa, Homo sapiens
  Payload ID: 10066
  Gene Symbol: MARCH8
  Gene Name: membrane-associated ring finger (C3HC4) 8, E3 ubiquitin protein ligase
  Uniprot ID: Q5T0T0
  ENSP ID: ENSP00000379118
AGSPPSASAPAPVSSFSRTSITPSSQDICRICHCEGDDESPLITPCHCTGSLHFVHQACLQQWIKSSDTRCCELCKYEFIMETKLKPLRKWEKLQMTSSERRKIMCSVTFHVIAITCVVWSLYVLIDRTAEEIKQGQATGILEWPFWTKLVVVAIGFTGGLLFMYVQCKVYVQLWKRLKAYNRVIYVQNCPETSKKNIFEKSPLTEPNFENKHGYGICHSDTNSSCCTEPEDTGAEIIHV

SEQ ID NO: 50412 - protein, 89 aa, Homo sapiens
  Payload ID: 10066
  Gene Symbol: MARCH8
  Gene Name: membrane-associated ring finger (C3HC4) 8, E3 ubiquitin protein ligase
  ENSP ID: ENSP00000396678
MSMPLHQISAIPSQDAISARVYRSKTKEKEREEQNEKTLGHFMSHSSNISKAGSPPSASAPAPVSSFSRTSITPSSQDICRICHCEGDD

SEQ ID NO: 50413 - protein, 573 aa, Homo sapiens
  Payload ID: 10066
  Gene Symbol: MARCH8
  Gene Name: membrane-associated ring finger (C3HC4) 8, E3 ubiquitin protein ligase
  Uniprot ID: Q5T0T0
  ENSP ID: ENSP00000411848
MSMPLHQISAIPSQDAISARVYRSKTKEKEREEQNEKTLGHFMSHSSNISKAGSPPSASAPAPVSSFSRTSITPSSQDICSSSAVFSECCHHSSVQSAVVSKAPHCQSSLTQGLTVTVICKDTLQASKRNSFGSEWAQALKPAKNTKARRTLKFSRSLNDVGEKAQDTSESFAYVERTCSEGKLILPQDTCLRTNRFHHKEKRTLNHKPLGNSKHSCVSCLSAGRSTASEVEAGKGGRPGLLLEEKADGEATSRSRQLLQYLFSLSHGLSASSLHRFHELESCAARLHTAKSSSGLAGSMGFCSDEMGDDDVFEDSTSAKLKSRVLRAPLCSTEKDSDLDCPSPFSEKLPPISPVSTSGDVCRICHCEGDDESPLITPCHCTGSLHFVHQACLQQWIKSSDTRCCELCKYEFIMETKLKPLRKWEKLQMTSSERRKIMCSVTFHVIAITCVVWSLYVLIDRTAEEIKQGQATGILEWPFWTKLVVVAIGFTGGLLFMYVQCKVYVQLWKRLKAYNRVIYVQNCPETSKKNIFEKSPLTEPNFENKHGYGICHSDTNSSCCTEPEDTGAEIIHV

SEQ ID NO: 50414 - protein, 38 aa, Homo sapiens
  Payload ID: 10066
  Gene Symbol: MARCH8
  Gene Name: membrane-associated ring finger (C3HC4) 8, E3 ubiquitin protein ligase
  ENSP ID: ENSP00000482034
AGSPPSASAPAPVSSFSRTSITPSSQDICRICHCEGDD

SEQ ID NO: 50415 - protein, 346 aa, Homo sapiens
  Payload ID: 10067
  Gene Symbol: MARCH9
  Gene Name: membrane-associated ring finger (C3HC4) 9
  Uniprot ID: Q86YJ5
  ENSP ID: ENSP00000266643
MLKSRLRMFLNELKLLVLTGGGRPRAEPQPRGGRGGGCGWAPFAGCSTRDGDGDEEEYYGSEPRARGLAGDKEPRAGPLPPPAPPLPPPGALDALSLSSSLDSGLRTPQCRICFQGPEQGELLSPCRCDGSVRCTHQPCLIRWISERGSWSCELCYFKYQVLAISTKNPLQWQAISLTVIEKVQIAAIVLGSLFLVASISWLIWSSLSPSAKWQRQDLLFQICYGMYGFMDVVCIGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHSGREVVMRVTTV

SEQ ID NO: 50416 - protein, 233 aa, Homo sapiens
  Payload ID: 10067
  Gene Symbol: MARCH9
  Gene Name: membrane-associated ring finger (C3HC4) 9
  Uniprot ID: Q86YJ5
  ENSP ID: ENSP00000446758
MVSDKCHILDLIKAQRRQMLILPEGFREGSWSTLLFRATHHLALHPFLGLFGALSPTQWQAISLTVIEKVQIAAIVLGSLFLVASISWLIWSSLSPSAKWQRQDLLFQICYGMYGFMDVVCIGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHSGREVVMRVTTV

SEQ ID NO: 50417 - protein, 1052 aa, Homo sapiens
  Payload ID: 10068
  Gene Symbol: MBTPS1
  Gene Name: membrane-bound transcription factor peptidase, site 1
  Uniprot ID: Q14703
  ENSP ID: ENSP00000344223
MKLVNIWLLLLVVLLCGKKHLGDRLEKKSFEKAPCPGCSHLTLKVEFSSTVVEYEYIVAFNGYFTAKARNSFISSALKSSEVDNWRIIPRNNPSSDYPSDFEVIQIKEKQKAGLLTLEDHPNIKRVTPQRKVFRSLKYAESDPTVPCNETRWSQKWQSSRPLRRASLSLGSGFWHATGRHSSRRLLRAIPRQVAQTLQADVLWQMGYTGANVRVAVFDTGLSEKHPHFKNVKERTNWTNERTLDDGLGHGTFVAGVIASMRECQGFAPDAELHIFRVFTNNQVSYTSWFLDAFNYAILKKIDVLNLSIGGPDFMDHPFVDKVWELTANNVIMVSAIGNDGPLYGTLNNPADQMDVIGVGGIDFEDNIARFSSRGMTTWELPGGYGRMKPDIVTYGAGVRGSGVKGGCRALSGTSVASPVVAGAVTLLVSTVQKRELVNPASMKQALIASARRLPGVNMFEQGHGKLDLLRAYQILNSYKPQASLSPSYIDLTECPYMWPYCSQPIYYGGMPTVVNVTILNGMGVTGRIVDKPDWQPYLPQNGDNIEVAFSYSSVLWPWSGYLAISISVTKKAASWEGIAQGHVMITVASPAETESKNGAEQTSTVKLPIKVKIIPTPPRSKRVLWDQYHNLRYPPGYFPRDNLRMKNDPLDWNGDHIHTNFRDMYQHLRSMGYFVEVLGAPFTCFDASQYGTLLMVDSEEEYFPEEIAKLRRDVDNGLSLVIFSDWYNTSVMRKVKFYDENTRQWWMPDTGGANIPALNELLSVWNMGFSDGLYEGEFTLANHDMYYASGCSIAKFPEDGVVITQTFKDQGLEVLKQETAVVENVPILGLYQIPAEGGGRIVLYGDSNCLDDSHRQKDCFWLLDALLQYTSYGVTPPSLSHSGNRQRPPSGAGSVTPERMEGNHLHRYSKVLEAHLGDPKPRPLPACPRLSWAKPQPLNETAPSNLWKHQKLLSIDLDKVVLPNFRSNRPQVRPLSPGESGAWDIPGGIMPGRYNQEVGQTIPVFAFLGAMVVLAFFVVQINKAKSRPKRRKPRVKRPQLMQQVHPPKTPSV

SEQ ID NO: 50418 - protein, 16 aa, Homo sapiens
  Payload ID: 10068
  Gene Symbol: MBTPS1
  Gene Name: membrane-bound transcription factor peptidase, site 1
  ENSP ID: ENSP00000456553
MKLVNIWLLLLVVLLC

SEQ ID NO: 50419 - protein, 81 aa, Homo sapiens
  Payload ID: 10068
  Gene Symbol: MBTPS1
  Gene Name: membrane-bound transcription factor peptidase, site 1
  ENSP ID: ENSP00000457508
  MOD_RES (1)..(1): Any amino acid
XLNLSIGGPDFMDHPFVDKVWELTANNVIMVSAIGNDGPLYGTLNNPADQMDVIGVGGIDFEDNIARFSSRGMTTWHSPEA

SEQ ID NO: 50420 - protein, 146 aa, Homo sapiens
  Payload ID: 10068
  Gene Symbol: MBTPS1
  Gene Name: membrane-bound transcription factor peptidase, site 1
  ENSP ID: ENSP00000457954
MRECQGFAPDAELHIFRVFTNNQVSYTSWFLDAFNYAILKKIDVLNLSIGGPDFMDHPFVDKVWELTANNVIMVSAIGNDGPLYGTLNNPADQMDVIGVGGIDFEDNIARFSSRGMTTWELPGGYGRMKPDIVTYGAGVRGSGVKG

SEQ ID NO: 50421 - protein, 134 aa, Homo sapiens
  Payload ID: 10068
  Gene Symbol: MBTPS1
  Gene Name: membrane-bound transcription factor peptidase, site 1
  ENSP ID: ENSP00000481088
VASPVVAGAVTLLVSTVQKRELVNPASMKQALIASARRLPGVNMFEQGHGKLDLLRAYQILNSYKPQARSVHRPADGSFSPSLGSGRIFPLHKIQASKQKMMTKHRILGVLGEVLLLLLQGAAGRTGSCFRLLM

SEQ ID NO: 50422 - protein, 330 aa, Homo sapiens
  Payload ID: 10069
  Gene Symbol: MBTPS2
  Gene Name: membrane-bound transcription factor peptidase, site 2
  ENSP ID: ENSP00000368796
MIPVSLVVVVVGGWTVVYLTDLVLKSSVYFKHSYEDWLENNGLSISPFHIRWQTAVFNRAFYSWGRRKARMLYQWFNFGMVFGVIAMFSSFFLLGKTLMQTLAQMMADSPSSYSSSSSSSSSSSSSSSSSSSSSSSLHNEQVLQVVVPGINLPVNQLTYFFTAVLISGVVHEIGHGIAAIREQVRFNGFGIFLFIIYPGAFVDLFTTHLQLISPVQQLRIFCAGIWHNFVLALLGILALVLLPVILLPFYYTGVGVLITEVAEDSPAIGPRGLFVGDLVTHLQDCPVTNVQDWNECLDTIAYEPQIGYCISASTLQQLSFPVRGVYISSI

SEQ ID NO: 50423 - protein, 519 aa, Homo sapiens
  Payload ID: 10069
  Gene Symbol: MBTPS2
  Gene Name: membrane-bound transcription factor peptidase, site 2
  Uniprot ID: O43462
  ENSP ID: ENSP00000368798
MIPVSLVVVVVGGWTVVYLTDLVLKSSVYFKHSYEDWLENNGLSISPFHIRWQTAVFNRAFYSWGRRKARMLYQWFNFGMVFGVIAMFSSFFLLGKTLMQTLAQMMADSPSSYSSSSSSSSSSSSSSSSSSSSSSSLHNEQVLQVVVPGINLPVNQLTYFFTAVLISGVVHEIGHGIAAIREQVRFNGFGIFLFIIYPGAFVDLFTTHLQLISPVQQLRIFCAGIWHNFVLALLGILALVLLPVILLPFYYTGVGVLITEVAEDSPAIGPRGLFVGDLVTHLQDCPVTNVQDWNECLDTIAYEPQIGYCISASTLQQLSFPVRAYKRLDGSTECCNNHSLTDVCFSYRNNFNKRLHTCLPARKAVEATQVCRTNKDCKKSSSSSFCIIPSLETHTRLIKVKHPPQIDMLYVGHPLHLHYTVSITSFIPRFNFLSIDLPVVVETFVKYLISLSGALAIVNAVPCFALDGQWILNSFLDATLTSVIGDNDVKDLIGFFILLGGSVLLAANVTLGLWMVTAR

SEQ ID NO: 50424 - protein, 297 aa, Homo sapiens
  Payload ID: 10070
  Gene Symbol: MS4A1
  Gene Name: membrane-spanning 4-domains, subfamily A, member 1
  Uniprot ID: P11836
  ENSP ID: ENSP00000314620
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 50425 - protein, 297 aa, Homo sapiens; identical to SEQ ID NO: 50424
  Payload ID: 10070
  Gene Symbol: MS4A1
  Gene Name: membrane-spanning 4-domains, subfamily A, member 1
  Uniprot ID: P11836
  ENSP ID: ENSP00000374589

SEQ ID NO: 50426 - protein, 6 aa, Homo sapiens
  Payload ID: 10070
  Gene Symbol: MS4A1
  Gene Name: membrane-spanning 4-domains, subfamily A, member 1
  ENSP ID: ENSP00000432219
MTTPRN

SEQ ID NO: 50427 - protein, 130 aa, Homo sapiens
  Payload ID: 10070
  Gene Symbol: MS4A1
  Gene Name: membrane-spanning 4-domains, subfamily A, member 1
  Uniprot ID: P11836
  ENSP ID: ENSP00000432270
MTTPRNSVNGTFPAEPMKGPIAMQSGPKPLFRRMSSLELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 50428 - protein, 7 aa, Homo sapiens
  Payload ID: 10070
  Gene Symbol: MS4A1
  Gene Name: membrane-spanning 4-domains, subfamily A, member 1
  ENSP ID: ENSP00000433179
MTTPRNS

SEQ ID NO: 50429 - protein, 297 aa, Homo sapiens; identical to SEQ ID NO: 50424
  Payload ID: 10070
  Gene Symbol: MS4A1
  Gene Name: membrane-spanning 4-domains, subfamily A, member 1
  Uniprot ID: P11836
  ENSP ID: ENSP00000433277

SEQ ID NO: 50430 - protein, 284 aa, Homo sapiens
  Payload ID: 10070
  Gene Symbol: MS4A1
  Gene Name: membrane-spanning 4-domains, subfamily A, member 1
  ENSP ID: ENSP00000433519
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 50431 - protein, 123 aa, Homo sapiens
  Payload ID: 10070
  Gene Symbol: MS4A1
  Gene Name: membrane-spanning 4-domains, subfamily A, member 1
  ENSP ID: ENSP00000437002
MTLMEEMLREAFRCMTQEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMN

SEQ ID NO: 50432 - protein, 267 aa, Homo sapiens
  Payload ID: 10071
  Gene Symbol: MS4A10
  Gene Name: membrane-spanning 4-domains, subfamily A, member 10
  Uniprot ID: Q96PG2
  ENSP ID: ENSP00000311862
MKAEATVIPSRCARGLPSWQVLSPVQPWQTSAPQNTTQPKLLAPHQHEKSQKKSSLLKELGAFHITIALLHLVFGGYLASIVKNLHLVVLKSWYPFWGAASFLISGILAITMKTFSKTYLKMLCLMTNLISLFCVLSGLFVISKDLFLESPFESPIWRMYPNSTVHIQRLELALLCFTVLELFLPVPTAVTAWRGDCPSAKNDDACLVPNTPLHLKGLPVEPPPSYQSVIQGDAQHKQHQRLREVKQVAPDTWIVTDGAAIWTQTAN

SEQ ID NO: 50433 - protein, 267 aa, Homo sapiens
  Payload ID: 10072
  Gene Symbol: MS4A12
  Gene Name: membrane-spanning 4-domains, subfamily A, member 12
  Uniprot ID: Q9NXJ0
  ENSP ID: ENSP00000016913
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISFSFREVLGFASTAVIGGYPFWGGLSFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 50434 - protein, 173 aa, Homo sapiens
  Payload ID: 10072
  Gene Symbol: MS4A12
  Gene Name: membrane-spanning 4-domains, subfamily A, member 12
  ENSP ID: ENSP00000431959
MMSSKPTSHAEVNETIPNPYPPSSFMAPGFQQPLGSINLENQAQGAQRAQPYGITSPGIFASSQPGQGNIQMINPSVGTAVMNFKEEAKALGFIISGSLSVSASKELSRCLVKGSLGMNIVSSILAFIGVILLLVDMCINGVAGQDYWAVLSGKGISATLMIFSLLEFFVACA

SEQ ID NO: 50435 - protein, 114 aa, Homo sapiens
  Payload ID: 10072
  Gene Symbol: MS4A12
  Gene Name: membrane-spanning 4-domains, subfamily A, member 12
  ENSP ID: ENSP00000434783
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISF

SEQ ID NO: 50436 - protein, 221 aa, Homo sapiens
  Payload ID: 10072
  Gene Symbol: MS4A12
  Gene Name: membrane-spanning 4-domains, subfamily A, member 12
  Uniprot ID: Q9NXJ0
  ENSP ID: ENSP00000440424
MMSSKPTSHAEVNETIPNPYPPSSFMAPGFQQPLGSINLENQAQGAQRAQPYGITSPGIFASSQPGQGNIQMINPSVGTAVMNFKEEAKALGFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 50437 - protein, 112 aa, Homo sapiens
  Payload ID: 10073
  Gene Symbol: MS4A13
  Gene Name: membrane-spanning 4-domains, subfamily A, member 13
  Uniprot ID: Q5J8X5
  ENSP ID: ENSP00000367427
MIGIFHIFMWYFLLVLYMGQIKGAFGTYEPVTYKTGCTLWGIFFIIAGVFLIRVTKYPTRSGKLGREVSRILLFFYGLEFSIALTHSIYSCSNLFRRQNDLTSVTEEAESTP

SEQ ID NO: 50438 - protein, 152 aa, Homo sapiens
  Payload ID: 10073
  Gene Symbol: MS4A13
  Gene Name: membrane-spanning 4-domains, subfamily A, member 13
  Uniprot ID: Q5J8X5
  ENSP ID: ENSP00000367428
MIGIFHIFMWYFLLVLYMGQIKGAFGTYEPVTYKTGCTLWGIFFIIAGVFLIRVTKYPTRSGIISTLIINIICIITTITAVTLTIIELSHFNSVSYRNYGQAKLGREVSRILLFFYGLEFSIALTHSIYSCSNLFRRQNDLTSVTEEAESTP

SEQ ID NO: 50439 - protein, 93 aa, Homo sapiens
  Payload ID: 10073
  Gene Symbol: MS4A13
  Gene Name: membrane-spanning 4-domains, subfamily A, member 13
  Uniprot ID: Q5J8X5
  ENSP ID: ENSP00000415535
MIGIFHIFMWYFLLVLYMGQIKGAFGTYEPVTYKTGCTLWGIFKLGREVSRILLFFYGLEFSIALTHSIYSCSNLFRRQNDLTSVTEEAESTP

SEQ ID NO: 50440 - protein, 61 aa, Homo sapiens
  Payload ID: 10073
  Gene Symbol: MS4A13
  Gene Name: membrane-spanning 4-domains, subfamily A, member 13
  ENSP ID: ENSP00000432713
MIGIFHIFMWYFLLVLYMGQIKGAFGTYEPVTYKTGCTLWGIFFRRQNDLTSVTEEAESTP

SEQ ID NO: 50441 - protein, 679 aa, Homo sapiens
  Payload ID: 10074
  Gene Symbol: MS4A14
  Gene Name: membrane-spanning 4-domains, subfamily A, member 14
  Uniprot ID: Q96JA4
  ENSP ID: ENSP00000300187
MESTSQDRRATHVITIKPNETVLTAFPYRPHSSLLDFLKGEPRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 50442 - protein, 695 aa, Homo sapiens
  Payload ID: 10074
  Gene Symbol: MS4A14
  Gene Name: membrane-spanning 4-domains, subfamily A, member 14
  ENSP ID: ENSP00000378449
MESTSQDRRATHVITIKPNETVLTAFPYRPHSSLLDFLKGEPRVLGATQILLALIIVGFGTIFALNYIGFSQRLPLVVLTGYPFWGALIGQGVTGMNVISSLVAITGITFTILSYRHQDKYCQMPSFEEICVFSRTLFIGILLILLIISIAELSISVTIASFRSKCWTQSDEVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 50443 - protein, 662 aa, Homo sapiens
  Payload ID: 10074
  Gene Symbol: MS4A14
  Gene Name: membrane-spanning 4-domains, subfamily A, member 14
  Uniprot ID: Q96JA4
  ENSP ID: ENSP00000378453
MESTSQDRRATHVITIKPNETVLTAFPYRPHSSLLDFLKGEPRVLGATQILLALIIVGFGTIFALNYIGFSQRLPLVVLTGYPFWGALIGQGVTGMNVISSLVAITGITFTILSYRHQDKYCQMPSFEEICVFSRTLFIVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 50444 - protein, 94 aa, Homo sapiens
  Payload ID: 10074
  Gene Symbol: MS4A14
  Gene Name: membrane-spanning 4-domains, subfamily A, member 14
  ENSP ID: ENSP00000432323
MESTSQDRRATHVITIKPNETVLTAFPYRPHSSLLDFLKGEPRVLGATQILLALIIVGFGTIFALNYIGFSQRLPLVVLTGYPFWGALIVSTVD

SEQ ID NO: 50445 - protein, 139 aa, Homo sapiens
  Payload ID: 10074
  Gene Symbol: MS4A14
  Gene Name: membrane-spanning 4-domains, subfamily A, member 14
  ENSP ID: ENSP00000433014
  MOD_RES (1)..(1): Any amino acid
XRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIVSGLILHEESLKSSLNCVHDVMIH

SEQ ID NO: 50446 - protein, 712 aa, Homo sapiens
  Payload ID: 10074
  Gene Symbol: MS4A14
  Gene Name: membrane-spanning 4-domains, subfamily A, member 14
  Uniprot ID: Q96JA4
  ENSP ID: ENSP00000433761
MESTSQDRRATHVITIKPNETVLTAFPYRPHSSLLDFLKGEPRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIGILLILLIISIAELSISVTIASFRSKCWTQSDEVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 50447 - protein, 170 aa, Homo sapiens
  Payload ID: 10074
  Gene Symbol: MS4A14
  Gene Name: membrane-spanning 4-domains, subfamily A, member 14
  ENSP ID: ENSP00000434271
MESTSQDRRATHVITIKPNETVLTAFPYRPHSSLLDFLKGEPRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIDFILLTPPHSSHFL

SEQ ID NO: 50448 - protein, 153 aa, Homo sapiens
  Payload ID: 10074
  Gene Symbol: MS4A14
  Gene Name: membrane-spanning 4-domains, subfamily A, member 14
  ENSP ID: ENSP00000434649
MESTSQDRRATHVITIKPNETVLTAFPYRPHSSLLDFLKGEPRVLGATQILLALIIVGFGTIFALNYIGFSQRLPLVVLTGYPFWGALIGQGVTGMNVISSLVAITGITFTILSYRHQDKYCQMPSFEEICVFSRTLFIDFILLTPPHSSHFL

SEQ ID NO: 50449 - protein, 148 aa, Homo sapiens
  Payload ID: 10074
  Gene Symbol: MS4A14
  Gene Name: membrane-spanning 4-domains, subfamily A, member 14
  ENSP ID: ENSP00000435764
MESTSQDRRATHVITIKPNETVLTAFPYRPHSSLLDFLKGEPRVLGATQILLALIIVGFGTIFALNYIGFSQRLPLVVLTGYPFWGALIGQGVTGMNVISSLVAITGITFTILSYRHQDKYCQMPSFEEICVFSRTLFIGILLILLII

SEQ ID NO: 50450 - protein, 153 aa, Homo sapiens; identical to SEQ ID NO: 50448
  Payload ID: 10074
  Gene Symbol: MS4A14
  Gene Name: membrane-spanning 4-domains, subfamily A, member 14
  ENSP ID: ENSP00000437003

SEQ ID NO: 50451 - protein, 567 aa, Homo sapiens
  Payload ID: 10074
  Gene Symbol: MS4A14
  Gene Name: membrane-spanning 4-domains, subfamily A, member 14
  ENSP ID: ENSP00000437222
MNVISSLVAITGITFTILSYRHQDKYCQMPSFEEICVFSRTLFIVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 50452 - protein, 147 aa, Homo sapiens
  Payload ID: 10075
  Gene Symbol: MS4A15
  Gene Name: membrane-spanning 4-domains, subfamily A, member 15
  Uniprot ID: Q8N5U1
  ENSP ID: ENSP00000338692
MVRRGHVGIFFIEGGVPFWGGACFIISGSLSVAAEKNHTSCLVRSSLGTNILSVMAAFAGTAILLMDFGVTNRDVDRGYLAVLTIFTVLEFFTAVIAMHFGCQAIHAQASAPVIFLPNAFSADFNIPSPAASAPPAYDNVAYAQGVV

SEQ ID NO: 50453 - protein, 240 aa, Homo sapiens
  Payload ID: 10075
  Gene Symbol: MS4A15
  Gene Name: membrane-spanning 4-domains, subfamily A, member 15
  Uniprot ID: Q8N5U1
  ENSP ID: ENSP00000386022
MSAAPASNGVFVVIPPNNASGLCPPPAILPTSMCQPPGIMQFEEPPLGAQTPRATQPPDLRPVETFLTGEPKVLGTVQILIGLIHLGFGSVLLMVRRGHVGIFFIEGGVPFWGGACFIISGSLSVAAEKNHTSCLVRSSLGTNILSVMAAFAGTAILLMDFGVTNRDVDRGYLAVLTIFTVLEFFTAVIAMHFGCQAIHAQASAPVIFLPNAFSADFNIPSPAASAPPAYDNVAYAQGVV

SEQ ID NO: 50454 - protein, 187 aa, Homo sapiens
  Payload ID: 10075
  Gene Symbol: MS4A15
  Gene Name: membrane-spanning 4-domains, subfamily A, member 15
  ENSP ID: ENSP00000413918
MSAAPASNGVFVVIPPNNASGLCPPPAILPTSMCQPPGIMQFEEPPLGAQTPRATQPPDLRPVETFLTGEPKVLGALAACCSWFAAATWASSSSRAASPSGEEPASSSPDPSQWQPRRTTPVACSFPSTSGDLQSARGGAPPRQTRRRLCMSRRRRQGYSFNTQARVESEVHAHGHSEKGKMLEDLL

SEQ ID NO: 50455 - protein, 199 aa, Homo sapiens
  Payload ID: 10075
  Gene Symbol: MS4A15
  Gene Name: membrane-spanning 4-domains, subfamily A, member 15
  Uniprot ID: Q8N5U1
  ENSP ID: ENSP00000434165
MSAAPASNGVFVVIPPNNASGLCPPPAILPTSMCQPPGIMQFEEPPLGAQTPRATQPPDLRPVETFLTGEPKVLGFIISGSLSVAAEKNHTSCLVRSSLGTNILSVMAAFAGTAILLMDFGVTNRDVDRGYLAVLTIFTVLEFFTAVIAMHFGCQAIHAQASAPVIFLPNAFSADFNIPSPAASAPPAYDNVAYAQGVV

SEQ ID NO: 50456 - protein, 323 aa, Homo sapiens
  Payload ID: 10076
  Gene Symbol: MS4A18
  Gene Name: membrane-spanning 4-domains, subfamily A, member 18
  Uniprot ID: Q3C1V0
  ENSP ID: ENSP00000381953
MTEQVIGANSVPGIIAPDNVHVIQPSNPVASGNHLQPSEVTTYPISPKVIHCDTGRANLQNLLVVNQNSAAGVQSQPIGYQRQYPVGTASLQTVPGVIQYTQGTTNLQTWPGDLQNPLNANPGLTHTSNSSQWNTSFASFTSFNPKKFINEEVRTLGAIQILIGLTHIFSAINPVLYYYPFVTWLSGYPLWGGLSYIVSGSLSVWAAKDPSPCVVNSSISFNIISALFAFAGIFIIITDLSLYYVTTYSKAVSGGLLPFALLEFILTCVVSHFGCQATCCRQFENVAVIPTVFSFNPANTTTSPVNATTGPVNAATGPVSATN

SEQ ID NO: 50457 - protein, 400 aa, Homo sapiens
  Payload ID: 10076
  Gene Symbol: MS4A18
  Gene Name: membrane-spanning 4-domains, subfamily A, member 18
  ENSP ID: ENSP00000431607
MTEQVIGANSVPGIIAPDNVHVIQPSNPVASGNHLQPSEVTTYPISPKVIHCDTGRANLQNLLVVNQNSAAGVQSQPIGYQRQYPVGTASLQTVPGVIQYTQGTTNLQTWPGDLQNPLNANPGLTHTSNSSQWNTSFASFTSFNPKKFINEEVRTLGVSAIQILIGLTHIFSAINPVLYYYPFVTWLSGYPLWGGLSYIVSGSLSVWAAKDPSPCVVNSSISFNIISALFAFAGIFIIITDLSLYYVTTYSKAVSGGLLPFALLEFILTCVVSHFGCQATCCRQFENVAVIPTVFSFNPANTTTSPVNATTGPVNAATGPVSATNGPVNTTIHPVNTTTSPVNTTTSPVNVTTGPVNANIGPVNVTTGPVNTTTAPAKATTSCVNAIHTSNVPPNPRTKK

SEQ ID NO: 50458 - protein, 244 aa, Homo sapiens
  Payload ID: 10077
  Gene Symbol: MS4A2
  Gene Name: membrane-spanning 4-domains, subfamily A, member 2
  Uniprot ID: Q01362
  ENSP ID: ENSP00000278888
MDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEDRVYEELNIYSATYSELEDPGEMSPPIDL

SEQ ID NO: 50459 - protein, 41 aa, Homo sapiens
  Payload ID: 10077
  Gene Symbol: MS4A2
  Gene Name: membrane-spanning 4-domains, subfamily A, member 2
  ENSP ID: ENSP00000433311
MDTESNRRANLALPQEPSSVPAFEVLEISPQEVSSGRLLKS

SEQ ID NO: 50460 - protein, 199 aa, Homo sapiens
  Payload ID: 10077
  Gene Symbol: MS4A2
  Gene Name: membrane-spanning 4-domains, subfamily A, member 2
  ENSP ID: ENSP00000482594
MDTESNRRANLALPQEPSSVPAFEVLEISPQEVSSGRLLKSASSPPLHTWLTVLKKEQEFLGFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEDRVYEELNIYSATYSELEDPGEMSPPIDL

SEQ ID NO: 50461 - protein, 214 aa, Homo sapiens
  Payload ID: 10078
  Gene Symbol: MS4A3
  Gene Name: membrane-spanning 4-domains, subfamily A, member 3 (hematopoietic cell-specific)
  Uniprot ID: Q96HJ5
  ENSP ID: ENSP00000278865
MASHEVDNAELGSASAHGTPGSEAGPEELNTSVYQPIDGSPDYQKAKLQVLGAIQILNAAMILALGVFLGSLQYPYHFQKHFFFFTFYTGYPIWGAVFFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 50462 - protein, 168 aa, Homo sapiens
  Payload ID: 10078
  Gene Symbol: MS4A3
  Gene Name: membrane-spanning 4-domains, subfamily A, member 3 (hematopoietic cell-specific)
  Uniprot ID: Q96HJ5
  ENSP ID: ENSP00000350872
MASHEVDNAELGSASAHGTPGSEAGPEELNTSVYQPIDGSPDYQKAKLQVLGFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 50463 - protein, 91 aa, Homo sapiens
  Payload ID: 10078
  Gene Symbol: MS4A3
  Gene Name: membrane-spanning 4-domains, subfamily A, member 3 (hematopoietic cell-specific)
  Uniprot ID: Q96HJ5
  ENSP ID: ENSP00000378473
MNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 50464 - protein, 83 aa, Homo sapiens
  Payload ID: 10078
  Gene Symbol: MS4A3
  Gene Name: membrane-spanning 4-domains, subfamily A, member 3 (hematopoietic cell-specific)
  ENSP ID: ENSP00000434109
MASHEVDNAELGSASAHGTPGSEAGPEELNTSVYQPIDGSPDYQKAKLQVLGSIQREEDEDEDLYDNLLPLNEYSVVQEPCLL

SEQ ID NO: 50465 - protein, 168 aa, Homo sapiens; identical to SEQ ID NO: 50462
  Payload ID: 10078
  Gene Symbol: MS4A3
  Gene Name: membrane-spanning 4-domains, subfamily A, member 3 (hematopoietic cell-specific)
  Uniprot ID: Q96HJ5
  ENSP ID: ENSP00000434117

SEQ ID NO: 50466 - protein, 239 aa, Homo sapiens [sequence omitted]

SEQ ID NO: 50467 - protein, 68 aa, Homo sapiens
  Payload ID: 10079
  Gene Symbol: MS4A4A
  Gene Name: membrane-spanning 4-domains, subfamily A, member 4A
  ENSP ID: ENSP00000340356
MHQTYSRHCRPEERWSQEGWNIPANGFNICRCLNIGMKLRLWNNLNKSNILGALKIKRREIRAPFLLP

SEQ ID NO: 50468 - protein, 186 aa, Homo sapiens
  Payload ID: 10079
  Gene Symbol: MS4A4A
  Gene Name: membrane-spanning 4-domains, subfamily A, member 4A
  Uniprot ID: Q96JQ5
  ENSP ID: ENSP00000434506
MHQTYSRHCRPEESTFSAAMTTMQGMEQAMPGAGPGVPQLGNMAVIHSHLWKGLQEKFLKGEPKVLGVVQILTALMSLSMGITMMCMASNTYGSNPISVYIGYTIWGSVMFIISGSLSIAAGIRTTKGLGLDGMVLLLSVLEFCIAVSLSAFGCKVLCCTPGGVVLILPSHSHMAETASPTPLNEV

SEQ ID NO: 50469 - protein, 35 aa, Homo sapiens
  Payload ID: 10079
  Gene Symbol: MS4A4A
  Gene Name: membrane-spanning 4-domains, subfamily A, member 4A
  ENSP ID: ENSP00000434983
TYSRHCRPEERLVSRISTSFFMDSNGGLIQRLIAF

SEQ ID NO: 50470 - protein, 68 aa, Homo sapiens; identical to SEQ ID NO: 50467
  Payload ID: 10079
  Gene Symbol: MS4A4A
  Gene Name: membrane-spanning 4-domains, subfamily A, member 4A
  ENSP ID: ENSP00000435309

SEQ ID NO: 50471 - protein, 132 aa, Homo sapiens
  Payload ID: 10080
  Gene Symbol: MS4A4E
  Gene Name: membrane-spanning 4-domains, subfamily A, member 4E
  Uniprot ID: Q96PG1
  ENSP ID: ENSP00000381954
MTTMQGMEQTTPGAGPDVPQLGNIDVIHSYLCKGLQEKFFKRKPKVLGVVRILIALMSLSMGIIMMCVAFSSYEEHPIFVYVAYTIWGSVMYPYQLQQELEQQKVWNYLKNLSWRIMGSYLCFGERSELKPL

SEQ ID NO: 50472 - protein, 167 aa, Homo sapiens
  Payload ID: 10080
  Gene Symbol: MS4A4E
  Gene Name: membrane-spanning 4-domains, subfamily A, member 4E
  ENSP ID: ENSP00000381956
MTTMQGMEQTTPGAGPDVPQLGNIDVIHSYLCKGLQEKFFKRKPKVLGVVRILIALMSLSMGIIMMCVAFSSYEEHPIFVYVAYTIWGSVMFIISVSLSVAAGIRTTKGLGTDGMVLLLSVLEFCIAVALSAFGCKVLCCSPSEFVLITPSNSHMAEIASPTPLKTV

SEQ ID NO: 50473 - protein, 89 aa, Homo sapiens
  Payload ID: 10080
  Gene Symbol: MS4A4E
  Gene Name: membrane-spanning 4-domains, subfamily A, member 4E
  Uniprot ID: Q96PG1
  ENSP ID: ENSP00000389556
MTTMQGMEQTTPGAGPDVPQLGNIDVIHSYLCKGLQEKFFKRKPKVLGYPYQLQQELEQQKVWNYLKNLSWRIMGSYLCFGERSELKPL

SEQ ID NO: 50474 - protein, 70 aa, Homo sapiens
  Payload ID: 10080
  Gene Symbol: MS4A4E
  Gene Name: membrane-spanning 4-domains, subfamily A, member 4E
  ENSP ID: ENSP00000435345
MTTMQGMEQTTPGAGPDVPQLGNIDVIHSYLCKGLQEKFFKRKPKVLGVLCGHKFSTHSGCADSDCLDEP

SEQ ID NO: 50475 - protein, 110 aa, Homo sapiens
  Payload ID: 10080
  Gene Symbol: MS4A4E
  Gene Name: membrane-spanning 4-domains, subfamily A, member 4E
  Uniprot ID: Q96PG1
  ENSP ID: ENSP00000435601
MTTMQGMEQTTPGAGPDVPQLGNIDVIHSYLCKGLQEKFFKRKPKVLGVLCGHKFSTHSVSLSVAAGIRTTKGLELSEEFKLENNGIIFVFWREIRVETTIRRQVRRLLK

SEQ ID NO: 50476 - protein, 67 aa, Homo sapiens
  Payload ID: 10080
  Gene Symbol: MS4A4E
  Gene Name: membrane-spanning 4-domains, subfamily A, member 4E
  ENSP ID: ENSP00000436124
  MOD_RES (1)..(1): Any amino acid
XQGMEQTTPGAGPDVPQLGNIDVIHSYLCKGLQEKFFKRKPKVLGVLCGHKFSTHSGCADSDCLDEP

SEQ ID NO: 50477 - protein, 132 aa, Homo sapiens; identical to SEQ ID NO: 50471
  Payload ID: 10080
  Gene Symbol: MS4A4E
  Gene Name: membrane-spanning 4-domains, subfamily A, member 4E
  Uniprot ID: Q96PG1
  ENSP ID: ENSP00000436446

SEQ ID NO: 50478 - protein, 200 aa, Homo sapiens
  Payload ID: 10081
  Gene Symbol: MS4A5
  Gene Name: membrane-spanning 4-domains, subfamily A, member 5
  Uniprot ID: Q9H3V2
  ENSP ID: ENSP00000300190
MDSSTAHSPVFLVFPPEITASEYESTELSATTFSTQSPLQKLFARKMKILGTIQILFGIMTFSFGVIFLFTLLKPYPRFPFIFLSGYPFWGSVLFINSGAFLIAVKRKTTETLIILSRIMNFLSALGAIAGIILLTFGFILDQNYICGYSHQNSQCKAVTVLFLGILITLMTFSIIELFISLPFSILGCHSEDCDCEQCC

SEQ ID NO: 50479 - protein, 34 aa, Homo sapiens
  Payload ID: 10081
  Gene Symbol: MS4A5
  Gene Name: membrane-spanning 4-domains, subfamily A, member 5
  ENSP ID: ENSP00000432836
  MOD_RES (1)..(1): Any amino acid
XTQSPLQKLFARKMKILGDIHSGALFCSLILEPS

SEQ ID NO: 50480 - protein, 123 aa, Homo sapiens
  Payload ID: 10081
  Gene Symbol: MS4A5
  Gene Name: membrane-spanning 4-domains, subfamily A, member 5
  ENSP ID: ENSP00000433802
  MOD_RES (1)..(1): Any amino acid
XLSATTFSTQSPLQKLFARKMKILGTIQILFGIMTFSFGVIFLFTLLKPYPRFPFIFLSGYPFWGSVLFINSGAFLIAVKRKTTETLGILITLMTFSIIELFISLPFSILGCHSEDCDCEQCC

SEQ ID NO: 50481 - protein, 67 aa, Homo sapiens
  Payload ID: 10081
  Gene Symbol: MS4A5
  Gene Name: membrane-spanning 4-domains, subfamily A, member 5
  ENSP ID: ENSP00000435192
MDSSTAHSPVFLVFPPEITASEYESTELSATTFSTQSPLQKLFARKMKILGDIHSGALFCSLILEPS

SEQ ID NO: 50482 - protein, 114 aa, Homo sapiens
  Payload ID: 10081
  Gene Symbol: MS4A5
  Gene Name: membrane-spanning 4-domains, subfamily A, member 5
  ENSP ID: ENSP00000435330
MDSSTAHSPVFLVFPPEITASEYESTELSATTFSTQSPLQKLFARKMKILGTIQILFGIMTFSFGVIFLFTLLKPYPRFPFIFLSGYPFWGSVLFINSGAFLIAVKRKTTETLK

SEQ ID NO: 50483 - protein, 253 aa, Homo sapiens
  Payload ID: 10082
  Gene Symbol: MS4A6A
  Gene Name: membrane-spanning 4-domains, subfamily A, member 6A
  Uniprot ID: Q9H2W1
  ENSP ID: ENSP00000392770
MVLLKLLEVYRKGSAGTFHKSTIFGNTIMTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGVSVLAGFT

SEQ ID NO: 50484 - protein, 178 aa, Homo sapiens
  Payload ID: 10082
  Gene Symbol: MS4A6A
  Gene Name: membrane-spanning 4-domains, subfamily A, member 6A
  Uniprot ID: Q9H2W1
  ENSP ID: ENSP00000392921
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQWNSLSDADLHSAGILPSCAHCCAAVETGLL

SEQ ID NO: 50485 - protein, 253 aa, Homo sapiens; identical to SEQ ID NO: 50483
  Payload ID: 10082
  Gene Symbol: MS4A6A
  Gene Name: membrane-spanning 4-domains, subfamily A, member 6A
  Uniprot ID: Q9H2W1
  ENSP ID: ENSP00000403212

SEQ ID NO: 50486 - protein, 141 aa, Homo sapiens
  Payload ID: 10082
  Gene Symbol: MS4A6A
  Gene Name: membrane-spanning 4-domains, subfamily A, member 6A
  Uniprot ID: Q9H2W1
  ENSP ID: ENSP00000431266
MTSQPVPNETIIVLPSNVINFSQAEKPEPTNQGQDSLKKHLHAEIKVIGTIQILCGMMVLSLGIILASASFSPNFTQVTSTLLNSAYPFIGPFFVSRVSEEGRMGQRGEEDANSLDFPPASLLCLICQEQGVNGESCSPVG

SEQ ID NO: 50487 - protein, 225 aa, Homo sapiens
  Payload ID: 10082
  Gene Symbol: MS4A6A
  Gene Name: membrane-spanning 4-domains, subfamily A, member 6A
  Uniprot ID: Q9H2W1
  ENSP ID: ENSP00000431901
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGVSVLAGFT

SEQ ID NO: 50488 - protein, 77 aa, Homo sapiens
  Payload ID: 10082
  Gene Symbol: MS4A6A
  Gene Name: membrane-spanning 4-domains, subfamily A, member 6A
  ENSP ID: ENSP00000433012
MVLLKLLEVYRKGSAGTFHKSTIFGNTIMTSQPVPNETIIVLPSNVINFSQAEKPEPTNQGQDSLKKHLHAEIKVIG

SEQ ID NO: 50489 - protein, 101 aa, Homo sapiens
  Payload ID: 10082
  Gene Symbol: MS4A6A
  Gene Name: membrane-spanning 4-domains, subfamily A, member 6A
  ENSP ID: ENSP00000433436
MVLLKLLEVYRKGSAGTFHKSTIFGNTIMTSQPVPNETIIVLPSNVINFSQAEKPEPTNQGQDSLKKHLHAEIKVIGTIQILCGMMVLSLGIILASASFSP

SEQ ID NO: 50490 - protein, 120 aa, Homo sapiens
  Payload ID: 10082
  Gene Symbol: MS4A6A
  Gene Name: membrane-spanning 4-domains, subfamily A, member 6A
  ENSP ID: ENSP00000435630
MTSQPVPNETIIVLPSNVINFSQAEKPEPTNQGQDSLKKHLHAEIKVIGTIQILCGMMVLSLGIILASASFSPNFTQVTSTLLNSAYPFIGPFFSMVMNFWVVMMSLSSLALYQSPQRKG

SEQ ID NO: 50491 - protein, 276 aa, Homo sapiens
  Payload ID: 10082
  Gene Symbol: MS4A6A
  Gene Name: membrane-spanning 4-domains, subfamily A, member 6A
  ENSP ID: ENSP00000435844
MVLLKLLEVYRKGSAGTFHKSTIFGNTIMTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGSVLFLPHSYIGNSGMSSKMTHDCGYEELLTS

SEQ ID NO: 50492 - protein, 113 aa, Homo sapiens
  Payload ID: 10082
  Gene Symbol: MS4A6A
  Gene Name: membrane-spanning 4-domains, subfamily A, member 6A
  ENSP ID: ENSP00000436133
  MOD_RES (1)..(1): Any amino acid
XSQAEKPEPTNQGQDSLKKHLHAEIKVIGFIISGSLSIATEKRLTKLLVHSSLVGSILSALSALVGFIILSVKQATLNPASLQWNSLSDADLHSAGILPSCAHCCAAVETGLL

SEQ ID NO: 50493 - protein, 114 aa, Homo sapiens
  Payload ID: 10082
  Gene Symbol: MS4A6A
  Gene Name: membrane-spanning 4-domains, subfamily A, member 6A
  ENSP ID: ENSP00000436172
MTSQPVPNETIIVLPSNVINFSQAEKPEPTNQGQDSLKKHLHAEIKVIGVHSSLVGSILSALSALVGFIILSVKQATLNPASLQWNSLSDADLHSAGILPSCAHCCAAVETGLL

SEQ ID NO: 50494 - protein, 248 aa, Homo sapiens
  Payload ID: 10082
  Gene Symbol: MS4A6A
  Gene Name: membrane-spanning 4-domains, subfamily A, member 6A
  Uniprot ID: Q9H2W1
  ENSP ID: ENSP00000436979
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGSVLFLPHSYIGNSGMSSKMTHDCGYEELLTS

SEQ ID NO: 50495 - protein, 23 aa, Homo sapiens
  Payload ID: 10082
  Gene Symbol: MS4A6A
  Gene Name: membrane-spanning 4-domains, subfamily A, member 6A
  ENSP ID: ENSP00000437152
MTSQPVPNETIIVLPSNVINFSQ

SEQ ID NO: 50496 - protein, 147 aa, Homo sapiens
  Payload ID: 10083
  Gene Symbol: MS4A6E
  Gene Name: membrane-spanning 4-domains, subfamily A, member 6E
  Uniprot ID: Q96DS6
  ENSP ID: ENSP00000300182
MTSQPISNETIIMLPSNVINFSQAEKPEPTNQGQDSLKKRLQAKVKVIGVHSSLAGSILSALSALVGFILLSVNPAALNPASLQCKLDEKDIPTRLLLSYDYHSPYTMDCHRAKASLAGTLSLMLVSTVLEFCLAVLTAVLQWKQTV

SEQ ID NO: 50497 - protein, 122 aa, Homo sapiens
  Payload ID: 10083
  Gene Symbol: MS4A6E
  Gene Name: membrane-spanning 4-domains, subfamily A, member 6E
  ENSP ID: ENSP00000432963
KPEPTNQGQDSLKKRLQAKVKVIGVHSSLAGSILSALSALVGFILLSVNPAALNPASLQCKLDEKDIPTRLLLSYDYHSPYTMDCHRAKASLAGTLSLMLVSTVLEFCLAVLTAVLQWKQTV

SEQ ID NO: 50498 - protein, 59 aa, Homo sapiens
  Payload ID: 10083
  Gene Symbol: MS4A6E
  Gene Name: membrane-spanning 4-domains, subfamily A, member 6E
  ENSP ID: ENSP00000436675
EPTNQGQDSLKKRLQAKVKVIGSLLKKLYCMKGGEKEGIYLGLGGKHRVLVSRIASALM

SEQ ID NO: 50499 - protein, 240 aa, Homo sapiens
  Payload ID: 10084
  Gene Symbol: MS4A7
  Gene Name: membrane-spanning 4-domains, subfamily A, member 7
  Uniprot ID: Q9GZW8
  ENSP ID: ENSP00000300184
MLLQSQTMGVSHSFTPKGITIPQREKPGHMYQNEDYLQNGLPTETTVLGTVQILCCLLISSLGAILVFAPYPSHFNPAISTTLMSGYPFLGALCFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 50500 - protein, 195 aa, Homo sapiens
  Payload ID: 10084
  Gene Symbol: MS4A7
  Gene Name: membrane-spanning 4-domains, subfamily A, member 7
  Uniprot ID: Q9GZW8
  ENSP ID: ENSP00000350983
MLLQSQTMGVSHSFTPKGITIPQREKPGHMYQNEDYLQNGLPTETTVLGFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 50501 - protein, 39 aa, Homo sapiens
  Payload ID: 10084
  Gene Symbol: MS4A7
  Gene Name: membrane-spanning 4-domains, subfamily A, member 7
  ENSP ID: ENSP00000431408
MYQNEDYLQNGLPTETTVLGFGITGSLSIISGKQSTKPF

SEQ ID NO: 50502 - protein, 98 aa, Homo sapiens
  Payload ID: 10084
  Gene Symbol: MS4A7
  Gene Name: membrane-spanning 4-domains, subfamily A, member 7
  ENSP ID: ENSP00000433184
MLLQSQTMGVSHSFTPKGITIPQREKPGHMYQNEDYLQNGLPTETTVLGTVQILCCLLISSLGAILVFAPYPSHFNPAISTTLMSGYPFLGALCGRSQ

SEQ ID NO: 50503 - protein, 169 aa, Homo sapiens
  Payload ID: 10084
  Gene Symbol: MS4A7
  Gene Name: membrane-spanning 4-domains, subfamily A, member 7
  ENSP ID: ENSP00000433861
MLLQSQTMGVSHSFTPKGITIPQREKPGHMYQNEDYLQNGLPTETTVLGFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNN

SEQ ID NO: 50504 - protein, 195 aa, Homo sapiens; identical to SEQ ID NO: 50500
  Payload ID: 10084
  Gene Symbol: MS4A7
  Gene Name: membrane-spanning 4-domains, subfamily A, member 7
  Uniprot ID: Q9GZW8
  ENSP ID: ENSP00000434637

SEQ ID NO: 50505 - protein, 161 aa, Homo sapiens
  Payload ID: 10084
  Gene Symbol: MS4A7
  Gene Name: membrane-spanning 4-domains, subfamily A, member 7
  ENSP ID: ENSP00000434819
MLLQSQTMGVSHSFTPKGITIPQREKPGHMYQNEDYLQNGLPTETTVLGDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQ

SEQ ID NO: 50506 - protein, 250 aa, Homo sapiens
  Payload ID: 10085
  Gene Symbol: MS4A8
  Gene Name: membrane-spanning 4-domains, subfamily A, member 8
  Uniprot ID: Q9BY19
  ENSP ID: ENSP00000300226
MNSMTSAVPVANSVLVVAPHNGYPVTPGIMSHVPLYPNSQPQVHLVPGNPPSLVSNVNGQPVQKALKEGKTLGAIQIIIGLAHIGLGSIMATVLVGEYLSISFYGGFPFWGGLWFIISGSLSVAAENQPYSYCLLSGSLGLNIVSAICSAVGVILFITDLSIPHPYAYPDYYPYAWGVNPGMAISGVLLVFCLLEFGIACASSHFGCQLVCCQSSNVSVIYPNIYAANPVITPEPVTSPPSYSSEIQANK

SEQ ID NO: 50507 - protein, 163 aa, Homo sapiens
  Payload ID: 10085
  Gene Symbol: MS4A8
  Gene Name: membrane-spanning 4-domains, subfamily A, member 8
  ENSP ID: ENSP00000433200
  MOD_RES (1)..(1): Any amino acid
XHNGYPVTPGIMSHVPLYPNSQPQVHLVPGNPPSLVSNVNGQPVQKALKEGKTLGAIQIIIGLAHIGLGSIMATVLVGEYLSISFYGGFPFWGGLWFIISGSLSVAAENQPYSYCLLSGSLGLNIVSAICSAVGVILFITDLSIPHPYAYPDYYPYAWGVFCQ

SEQ ID NO: 50508 - protein, 88 aa, Homo sapiens
  Payload ID: 10085
  Gene Symbol: MS4A8
  Gene Name: membrane-spanning 4-domains, subfamily A, member 8
  ENSP ID: ENSP00000435567
MNSMTSAVPVANSVLVVAPHNGYPVTPGIMSHVPLYPNSQPQVHLVPGNPPSLVSNVNGQPVQKALKEGKTLGAFSERERKATKKQHA

SEQ ID NO: 50509 - protein, 224 aa, Homo sapiens
  Payload ID: 10085
  Gene Symbol: MS4A8
  Gene Name: membrane-spanning 4-domains, subfamily A, member 8
  ENSP ID: ENSP00000436857
MNSMTSAVPVANSVLVVAPHNGYPVTPGIMSHVPLYPNSQPQVHLVPGNPPSLVSNVNGQPVQKALKEGKTLGAIQIIIGLAHIGLGSIMATVLVGEYLSISFYGGFPFWGGLWFIISGSLSVAAENQPYSYCLLSGSLGLNIVSAICSAVGVILFITDLKPWNGDFWRAAGLLPPGVWHRMRIFPLWLPVGLLSIKQCECHLSKHLCSKPSDHPRTGDLTTKL

SEQ ID NO: 50510 - protein, 1320 aa, Homo sapiens
  Payload ID: 10086
  Gene Symbol: MN1
  Gene Name: meningioma (disrupted in balanced translocation) 1
  Uniprot ID: Q10571
  ENSP ID: ENSP00000304956
MFGLDQFEPQVNSRNAGQGERNFNETGLSMNTHFKAPAFHTGGPPGPVDPAMSALGEPPILGMNMEPYGFHARGHSELHAGGLQAQPVHGFFGGQQPHHGHPGSHHPHQHHPHFGGNFGGPDPGASCLHGGRLLGYGGAAGGLGSQPPFAEGYEHMAESQGPESFGPQRPGNLPDFHSSGASSHAVPAPCLPLDQSPNRAASFHGLPSSSGSDSHSLEPRRVTNQGAVDSLEYNYPGEAPSGHFDMFSPSDSEGQLPHYAAGRQVPGGAFPGASAMPRAAGMVGLSKMHAQPPQQQPQQQQQPQQQQQQHGVFFERFSGARKMPVGLEPSVGSRHPLMQPPQQAPPPPQQQPPQQPPQQQPPPPPGLLVRQNSCPPALPRPQQGEAGTPSGGLQDGGPMLPSQHAQFEYPIHRLENRSMHPYSEPVFSMQHPPPQQAPNQRLQHFDAPPYMNVAKRPRFDFPGSAGVDRCASWNGSMHNGALDNHLSPSAYPGLPGEFTPPVPDSFPSGPPLQHPAPDHQSLQQQQQQQQQQQQQQQQQQQQQQQQQQQQRQNAALMIKQMASRNQQQRLRQPNLAQLGHPGDVGQGGLVHGGPVGGLAQPNFEREGGSTGAGRLGTFEQQAPHLAQESAWFSGPHPPPGDLLPRRMGGSGLPADCGPHDPSLAPPPPPGGSGVLFRGPLQEPMRMPGEGHVPALPSPGLQFGGSLGGLGQLQSPGAGVGLPSAASERRPPPPDFATSALGGQPGFPFGAAGRQSTPHSGPGVNSPPSAGGGGGSSGGGGGGGAYPPQPDFQPSQRTSASKLGALSLGSFNKPSSKDNLFGQSCLAALSTACQNMIASLGAPNLNVTFNKKNPPEGKRKLSQNETDGAAVAGNPGSDYFPGGTAPGAPGPGGPSGTSSSGSKASGPPNPPAQGDGTSLSPNYTLESTSGNDGKPVSGGGGRGRGRRKRDSGHVSPGTFFDKYSAAPDSGGAPGVSPGQQQASGAAVGGSSAGETRGAPTPHEKALTSPSWGKGAELLLGDQPDLIGSLDGGAKSDSSSPNVGEFASDEVSTSYANEDEVSSSSDNPQALVKASRSPLVTGSPKLPPRGVGAGEHGPKAPPPALGLGIMSNSTSTPDSYGGGGGPGHPGTPGLEQVRTPTSSSGAPPPDEIHPLEILQAQIQLQRQQFSISEDQPLGLKGGKKGECAVGASGAQNGDSELGSCCSEAVKSAMSTIDLDSLMAEHSAAWYMPADKALVDSADDDKTLAPWEKAKPQNPNSKEAHDLPANKASASQPGSHLQCLSVHCTDDVGDAKARASVPTWRSLHSDISNRFGTFVAALT

SEQ ID NO: 50511 - protein, 105 aa, Homo sapiens
  Payload ID: 10086
  Gene Symbol: MN1
  Gene Name: meningioma (disrupted in balanced translocation) 1
  ENSP ID: ENSP00000397805
  MOD_RES (1)..(1): Any amino acid
XDSLMAEHSAAWYMPADKALVDSADDDKTLAPWEKAKPQNPNSKEAHDLPANKASASQPGSHLQCLSVHCTDDVGDAKARASVPTWRSLHSDISNRFGTFVAALT

SEQ ID NO: 50512 - protein, 849 aa, Homo sapiens
  Payload ID: 10087
  Gene Symbol: MGEA5
  Gene Name: meningioma expressed antigen 5 (hyaluronidase)
  Uniprot ID: O60502
  ENSP ID: ENSP00000350445
MVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 50513 - protein, 916 aa, Homo sapiens
  Payload ID: 10087
  Gene Symbol: MGEA5
  Gene Name: meningioma expressed antigen 5 (hyaluronidase)
  Uniprot ID: O60502
  ENSP ID: ENSP00000354850
MVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 50514 - protein, 677 aa, Homo sapiens
  Payload ID: 10087
  Gene Symbol: MGEA5
  Gene Name: meningioma expressed antigen 5 (hyaluronidase)
  Uniprot ID: O60502
  ENSP ID: ENSP00000359112
MVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGRCTRNNLFSSNILSL

SEQ ID NO: 50515 - protein, 863 aa, Homo sapiens
  Payload ID: 10087
  Gene Symbol: MGEA5
  Gene Name: meningioma expressed antigen 5 (hyaluronidase)
  Uniprot ID: O60502
  ENSP ID: ENSP00000409973
MVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 50516 - protein, 256 aa, Homo sapiens
  Payload ID: 10087
  Gene Symbol: MGEA5
  Gene Name: meningioma expressed antigen 5 (hyaluronidase)
  ENSP ID: ENSP00000414235
AAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTGPKVVSKEIPVESIEEVSKIIKRAPVIWDNIHANDYDQKRLFLGPYKGRSTELIPRLKGVLTNPNCEFEANYVAIHTLATWYKSNMNGVRK

SEQ ID NO: 50517 - protein, 746 aa, Homo sapiens
  Payload ID: 10088
  Gene Symbol: MEP1A
  Gene Name: meprin A, alpha (PABA peptide hydrolase)
  Uniprot ID: Q16819
  ENSP ID: ENSP00000230588
MAWIRSTCILFFTLLFAHIAAVPIKYLPEENVHDADFGEQKDISEINLAAGLDLFQGDILLQKSRNGLRDPNTRWTFPIPYILADNLGLNAKGAILYAFEMFRLKSCVDFKPYEGESSYIIFQQFDGCWSEVGDQHVGQNISIGQGCAYKAIIEHEILHALGFYHEQSRTDRDDYVNIWWDQILSGYQHNFDTYDDSLITDLNTPYDYESLMHYQPFSFNKNASVPTITAKIPEFNSIIGQRLDFSAIDLERLNRMYNCTTTHTLLDHCTFEKANICGMIQGTRDDTDWAHQDSAQAGEVDHTLLGQCTGAGYFMQFSTSSGSAEEAALLESRILYPKRKQQCLQFFYKMTGSPSDRLVVWVRRDDSTGNVRKLVKVQTFQGDDDHNWKIAHVVLKEEQKFRYLFQGTKGDPQNSTGGIYLDDITLTETPCPTGVWTVRNFSQVLENTSKGDKLQSPRFYNSEGYGFGVTLYPNSRESSGYLRLAFHVCSGENDAILEWPVENRQVIITILDQEPDVRNRMSSSMVFTTSKSHTSPAINDTVIWDRPSRVGTYHTDCNCFRSIDLGWSGFISHQMLKRRSFLKNDDLIIFVDFEDITHLSQTEVPTKGKRLSPQGLILQGQEQQVSEEGSGKAMLEEALPVSLSQGQPSRQKRSVENTGPLEDHNWPQYFRDPCDPNPCQNDGICVNVKGMASCRCISGHAFFYTGERCQAVQVHGSVLGMVIGGTAGVIFLTFSIIAILSQRPRK

SEQ ID NO: 50518 - protein, 774 aa, Homo sapiens
  Payload ID: 10088
  Gene Symbol: MEP1A
  Gene Name: meprin A, alpha (PABA peptide hydrolase)
  ENSP ID: ENSP00000480465
MAWIRSTCILFFTLLFAHIAAVPVSRVLLFGYLEILILVYIIHFLYIYFFQIKYLPEENVHDADFGEQKDISEINLAAGLDLFQGDILLQKSRNGLRDPNTRWTFPIPYILADNLGLNAKGAILYAFEMFRLKSCVDFKPYEGESSYIIFQQFDGCWSEVGDQHVGQNISIGQGCAYKAIIEHEILHALGFYHEQSRTDRDDYVNIWWDQILSGYQHNFDTYDDSLITDLNTPYDYESLMHYQPFSFNKNASVPTITAKIPEFNSIIGQRLDFSAIDLERLNRMYNCTTTHTLLDHCTFEKANICGMIQGTRDDTDWAHQDSAQAGEVDHTLLGQCTGAGYFMQFSTSSGSAEEAALLESRILYPKRKQQCLQFFYKMTGSPSDRLVVWVRRDDSTGNVRKLVKVQTFQGDDDHNWKIAHVVLKEEQKFRYLFQGTKGDPQNSTGGIYLDDITLTETPCPTGVWTVRNFSQVLENTSKGDKLQSPRFYNSEGYGFGVTLYPNSRESSGYLRLAFHVCSGENDAILEWPVENRQVIITILDQEPDVRNRMSSSMVFTTSKSHTSPAINDTVIWDRPSRVGTYHTDCNCFRSIDLGWSGFISHQMLKRRSFLKNDDLIIFVDFEDITHLSQTEVPTKGKRLSPQGLILQGQEQQVSEEGSGKAMLEEALPVSLSQGQPSRQKRSVENTGPLEDHNWPQYFRDPCDPNPCQNDGICVNVKGMASCRCISGHAFFYTGERCQAVQVHGSVLGMVIGGTAGVIFLTFSIIAILSQRPRK

SEQ ID NO: 50519 - protein, 701 aa, Homo sapiens
  Payload ID: 10089
  Gene Symbol: MEP1B
  Gene Name: meprin A, beta
  Uniprot ID: Q16820
  ENSP ID: ENSP00000269202
MDLWNLSWFLFLDALLVISGLATPENFDVDGGMDQDIFDINEGLGLDLFEGDIRLDRAQIRNSIIGEKYRWPHTIPYVLEDSLEMNAKGVILNAFERYRLKTCIDFKPWAGETNYISVFKGSGCWSSVGNRRVGKQELSIGANCDRIATVQHEFLHALGFWHEQSRSDRDDYVRIMWDRILSGREHNFNTYSDDISDSLNVPYDYTSVMHYSKTAFQNGTEPTIVTRISDFEDVIGQRMDFSDSDLLKLNQLYNCSSSLSFMDSCSFELENVCGMIQSSGDNADWQRVSQVPRGPESDHSNMGQCQGSGFFMHFDSSSVNVGATAVLESRTLYPKRGFQCLQFYLYNSGSESDQLNIYIREYSADNVDGNLTLVEEIKEIPTGSWQLYHVTLKVTKKFRVVFEGRKGSGASLGGLSIDDINLSETRCPHHIWHIRNFTQFIGSPNGTLYSPPFYSSKGYAFQIYLNLAHVTNAGIYFHLISGANDDQLQWPCPWQQATMTLLDQNPDIRQRMSNQRSITTDPFMTTDNGNYFWDRPSKVGTVALFSNGTQFRRGGGYGTSAFITHERLKSRDFIKGDDVYILLTVEDISHLNSTQIQLTPAPSVQDLCSKTTCKNDGVCTVRDGKAECRCQSGEDWWYMGERCEKRGSTRDTIVIAVSSTVAVFALMLIITLVSVYCTRKKYRERMSSNRPNLTPQNQHAF

SEQ ID NO: 50520 - protein, 114 aa, Homo sapiens
  Payload ID: 10089
  Gene Symbol: MEP1B
  Gene Name: meprin A, beta
  ENSP ID: ENSP00000462038
MDQDIFDINEGLGLDLFEGDIRLDRAQIRNSIIGEKYRWPHTIPYVLEDSLEMNAKGVILNAFERYRLKTCIDFKPWAGETNYISVFKGSGCWSSVGNRRVGKQELSIGANCDR

SEQ ID NO: 50521 - protein, 700 aa, Homo sapiens
  Payload ID: 10089
  Gene Symbol: MEP1B
  Gene Name: meprin A, beta
  ENSP ID: ENSP00000463280
MDLWNLSWFLFLDALLVISGLATPENFDVDGGMDQDIFDINEGLGLDLFEGDIRLDRAQIRNSIIGEKYRWPHTIPYVLEDSLEMNAKGVILNAFERYRLKTCIDFKPWAGETNYISVFKGSGCWSSVGNRRVGKQELSIGANCDRIATVQHEFLHALGFWHEQSRSDRDDYVRIMWDRILSGREHNFNTYSDDISDSLNVPYDYTSVMHYSKTAFQNGTEPTIVTRISDFEDVIGQRMDFSDSDLLKLNQLYNCSSSLSFMDSCSFELENVCGMIQSSGDNADWQRVSQVPRGPESDHSNMGQCQGSGFFMHFDSSSVNVGATAVLESRTLYPKRGFQCLQFYLYNSGSESDQLNIYIREYSADNVDGNLTLVEEIKEIPTGSWQLYHVTLKVTKKFRVVFEGRKGSGASLGGLSIDDINLSETRCPHHIWHIRNFTQFIGSPNGTLYSPPFYSSKGYAFQIYLNLAHVTNAGIYFHLISGANDDQLQWPCPWQQATMTLLDQNPDIRQRMSNQRSITTDPFMTTDNGNYFWDRPSKVGTVALFSNGTQFRRGGGYGTSAFITHERLKSRDFIKGDDVYILLTVEDISHLNSTQIQLTPAPSVQDLCSKTTCKNDGVCTVRDGKAECRCQSGEDWWYMGERCEKRGSTRDTIVIAVSSTVAVFALMLIITLVSVYCTRKKYRERMSSNRPNLTPQNHAF

SEQ ID NO: 50522 - protein, 999 aa, Homo sapiens
  Payload ID: 10090
  Gene Symbol: MERTK
  Gene Name: MER proto-oncogene, tyrosine kinase
  Uniprot ID: Q12866
  ENSP ID: ENSP00000295408
MGPAPLPLLLGLFLPALWRRAITEAREEAKPYPLFPGPFPGSLQTDHTPLLSLPHASGYQPALMFSPTQPGRPHTGNVAIPQVTSVESKPLPPLAFKHTVGHIILSEHKGVKFNCSISVPNIYQDTTISWWKDGKELLGAHHAITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPSVLTVPGLTEMAVFSCEAHNDKGLTVSKGVQINIKAIPSPPTEVSIRNSTAHSILISWVPGFDGYSPFRNCSIQVKEADPLSNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 50523 - protein, 823 aa, Homo sapiens
  Payload ID: 10090
  Gene Symbol: MERTK
  Gene Name: MER proto-oncogene, tyrosine kinase
  ENSP ID: ENSP00000387277
MKINNEEIVSDPIYIEVQGLPHFTKQPESMNVTRNTAFNLTCQAVGPPEPVNIFWVQNSSRVNEQPEKSPSVLTVPGLTEMAVFSCEAHNDKGLTVSKGVQINIKAIPSPPTEVSIRNSTAHSILISWVPGFDGYSPFRNCSIQVKEADPLSNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 50524 - protein, 999 aa, Homo sapiens; identical to SEQ ID NO: 50522
  Payload ID: 10090
  Gene Symbol: MERTK
  Gene Name: MER proto-oncogene, tyrosine kinase
  Uniprot ID: Q12866
  ENSP ID: ENSP00000389152

SEQ ID NO: 50525 - protein, 96 aa, Homo sapiens
  Payload ID: 10090
  Gene Symbol: MERTK
  Gene Name: MER proto-oncogene, tyrosine kinase
  ENSP ID: ENSP00000402129
MGPAPLPLLLGLFLPALWRRAITEAREEAKPYPLFPGPFPGSLQTDHTPLLSLPHASGYQPALMFSPTQPGRPHTGNVAIPQHNQCAAFRQWVVYL

SEQ ID NO: 50526 - protein, 257 aa, Homo sapiens
  Payload ID: 10090
  Gene Symbol: MERTK
  Gene Name: MER proto-oncogene, tyrosine kinase
  ENSP ID: ENSP00000412660
HIPLQTLLKFMVDIALGMEYLSNRNFLHRDLAARNCITHLAILARSPASCSYCRLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNG

SEQ ID NO: 50527 - protein, 588 aa, Homo sapiens [sequence omitted]

SEQ ID NO: 50528 - protein, 297 aa, Homo sapiens
  Payload ID: 10091
  Gene Symbol: MPST
  Gene Name: mercaptopyruvate sulfurtransferase
  Uniprot ID: P25325
  ENSP ID: ENSP00000342333
MASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 50529 - protein, 297 aa, Homo sapiens; identical to SEQ ID NO: 50528
  Payload ID: 10091
  Gene Symbol: MPST
  Gene Name: mercaptopyruvate sulfurtransferase
  Uniprot ID: P25325
  ENSP ID: ENSP00000380402

SEQ ID NO: 50530 - protein, 297 aa, Homo sapiens; identical to SEQ ID NO: 50528
  Payload ID: 10091
  Gene Symbol: MPST
  Gene Name: mercaptopyruvate sulfurtransferase
  Uniprot ID: P25325
  ENSP ID: ENSP00000383950

SEQ ID NO: 50531 - protein, 297 aa, Homo sapiens; identical to SEQ ID NO: 50528
  Payload ID: 10091
  Gene Symbol: MPST
  Gene Name: mercaptopyruvate sulfurtransferase
  Uniprot ID: P25325
  ENSP ID: ENSP00000384812

SEQ ID NO: 50532 - protein, 224 aa, Homo sapiens
  Payload ID: 10091
  Gene Symbol: MPST
  Gene Name: mercaptopyruvate sulfurtransferase
  ENSP ID: ENSP00000385062
MASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGSGSTAQAGVQWHNHGSLQPQPPGLR

SEQ ID NO: 50533 - protein, 317 aa, Homo sapiens
  Payload ID: 10091
  Gene Symbol: MPST
  Gene Name: mercaptopyruvate sulfurtransferase
  Uniprot ID: P25325
  ENSP ID: ENSP00000411719
MAEPGSRESETRARSPSVAAMASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 50534 - protein, 224 aa, Homo sapiens; identical to SEQ ID NO: 50532
  Payload ID: 10091
  Gene Symbol: MPST
  Gene Name: mercaptopyruvate sulfurtransferase
  ENSP ID: ENSP00000486251

SEQ ID NO: 50535 - protein, 71 aa, Homo sapiens
  Payload ID: 10092
  Gene Symbol: MANF
  Gene Name: mesencephalic astrocyte-derived neurotrophic factor
  ENSP ID: ENSP00000405280
  MOD_RES (1)..(1): Any amino acid
XATQGLAVALALSVLPGSRALRPGDCEVCISYLGRFYQDLKDRDVTFSPATIENELIKFCREARGKENRLV

SEQ ID NO: 50536 - protein, 185 aa, Homo sapiens
  Payload ID: 10092
  Gene Symbol: MANF
  Gene Name: mesencephalic astrocyte-derived neurotrophic factor
  ENSP ID: ENSP00000432799
MRRMRRMWATQGLAVALALSVLPGSRALRPGDCEVCISYLGRFYQDLKDRDVTFSPATIENELIKFCREARGKENRLCYYIGATDDAATKIINEVSKPLAHHIPVEKICEKLKKKDSQICELKYDKQIDLSTVDLKKLRVKELKKILDDWGETCKGCAEKSDYIRKINELMPKYAPKAASARTDL

SEQ ID NO: 50537 - protein, 254 aa, Homo sapiens
  Payload ID: 10093
  Gene Symbol: MEOX1
  Gene Name: mesenchyme homeobox 1
  Uniprot ID: P50221
  ENSP ID: ENSP00000321684
MDPAASSCMRSLQPPAPVWGCLRNPHSEGNGASGLPHYPPTPFSFHQKPDFLATATAAYPDFSASCLAATPHSLPQEEHIFTEQHPAFPQSPNWHFPVSDARRRPNSGPAGGSKEMGTSSLGLVDTTGGPGDDYGVLGSTANETEKKSSRRRKESSDNQENRGKPEGSSKARKERTAFTKEQLRELEAEFAHHNYLTRLRRYEIAVNLDLSERQVKVWFQNRRMKWKRVKGGQPISPNGQDPEDGDSTASPSSE

SEQ ID NO: 50538 - protein, 184 aa, Homo sapiens
  Payload ID: 10093
  Gene Symbol: MEOX1
  Gene Name: mesenchyme homeobox 1
  Uniprot ID: P50221
  ENSP ID: ENSP00000328678
MDPAASSCMRSLQPPAPVWGCLRNPHSEGNGASGLPHYPPTPFSFHQKPDFLATATAAYPDFSASCLAATPHSLPQEEHIFTEQHPAFPQSPNWHFPVSDARRRPNSGPAGGSKEMGTSSLGLVDTTGGPGDDYGVLGSTANETEKKSSRRRKESSGQSVVPEPKDEVEACEGRSAHLPQWAGP

SEQ ID NO: 50539 - protein, 139 aa, Homo sapiens
  Payload ID: 10093
  Gene Symbol: MEOX1
  Gene Name: mesenchyme homeobox 1
  Uniprot ID: P50221
  ENSP ID: ENSP00000377271
MGTSSLGLVDTTGGPGDDYGVLGSTANETEKKSSRRRKESSDNQENRGKPEGSSKARKERTAFTKEQLRELEAEFAHHNYLTRLRRYEIAVNLDLSERQVKVWFQNRRMKWKRVKGGQPISPNGQDPEDGDSTASPSSE

SEQ ID NO: 50540 - protein, 167 aa, Homo sapiens
  Payload ID: 10093
  Gene Symbol: MEOX1
  Gene Name: mesenchyme homeobox 1
  ENSP ID: ENSP00000449049
MGPQGYPTTRPPRSPSTRNQTSWRQRRQRTLTSQPPAWQPPHTACPRRSTSSLSSTPLSHSPPTGTSLSQTPGAGPTQARQGVPRKWGPAAWAWWTPQEAQAMTTGCLGALPMRQRRNHPGGERRVQVKVWFQNRRMKWKRVKGGQPISPNGQDPEDGDSTASPSSE

SEQ ID NO: 50541 - protein, 304 aa, Homo sapiens
  Payload ID: 10094
  Gene Symbol: MEOX2
  Gene Name: mesenchyme homeobox 2
  Uniprot ID: P50222
  ENSP ID: ENSP00000262041
MEHPLFGCLRSPHATAQGLHPFSQSSLALHGRSDHMSYPELSTSSSSCIIAGYPNEEGMFASQHHRGHHHHHHHHHHHHHQQQQHQALQTNWHLPQMSSPPSAARHSLCLQPDSGGPPELGSSPPVLCSNSSSLGSSTPTGAACAPGDYGRQALSPAEAEKRSGGKRKSDSSDSQEGNYKSEVNSKPRKERTAFTKEQIRELEAEFAHHNYLTRLRRYEIAVNLDLTERQVKVWFQNRRMKWKRVKGGQQGAAAREKELVNVKKGTLLPSELSGIGAATLQQTGDSIANEDSHDSDHSSEHAHL

SEQ ID NO: 50542 - protein, 303 aa, Homo sapiens
  Payload ID: 10095
  Gene Symbol: MEDAG
  Gene Name: mesenteric estrogen-dependent adipogenesis
  Uniprot ID: Q5VYS4
  ENSP ID: ENSP00000369849
MAGAACEPVARPSLTSISSGELRSLWTCDCELALLPLAQLLRLQPGAFQLSGDQLVVARPGEPAAARGGFNVFGDGLVRLDGQLYRLSSYIKRYVELTNYCDYKDYRETILSKPMLFFINVQTKKDTSKERTYAFLVNTRHPKIRRQIEQGMDMVISSVIGESYRLQFDFQEAVKNFFPPGNEVVNGENLSFAYEFKADALFDFFYWFGLSNSVVKVNGKVLNLSSTSPEKKETIKLFLEKMSEPLIRRSSFSDRKFSVTSRGSIDDVFNCNLSPRSSLTEPLLAELPFPSVLESEETPNQFI

SEQ ID NO: 50543 - protein, 106 aa, Homo sapiens
  Payload ID: 10095
  Gene Symbol: MEDAG
  Gene Name: mesenteric estrogen-dependent adipogenesis
  ENSP ID: ENSP00000416838
  MOD_RES (1)..(1): Any amino acid
XAARGGFNVFGDGLVRLDGQLYRLSSYIKRYVELTNYCDYKDYRETILSKPMLFFINVQTKKDTSKERTYAFLVNTRHPKIRRQIEQGMDMVISSVIGESYRLQVQ

SEQ ID NO: 50544 - protein, 362 aa, Homo sapiens
  Payload ID: 10096
  Gene Symbol: MESDC1
  Gene Name: mesoderm development candidate 1
  Uniprot ID: Q9H1K6
  ENSP ID: ENSP00000267984
MASGSAGKPTGEAASPAPASAIGGASSQPRKRLVSVCDHCKGKMQLVADLLLLSSEARPVLFEGPASSGAGAESFEQCRDTIIARTKGLSILTHDVQSQLNMGRFGEAGDSLVELGDLVVSLTECSAHAAYLAAVATPGAQPAQPGLVDRYRVTRCRHEVEQGCAVLRATPLADMTPQLLLEVSQGLSRNLKFLTDACALASDKSRDRFSREQFKLGVKCMSTSASALLACVREVKVAPSELARSRCALFSGPLVQAVSALVGFATEPQFLGRAAAVSAEGKAVQTAILGGAMSVVSACVLLTQCLRDLAQHPDGGAKMSDHRERLRNSACAVSEGCTLLSQALRERSSPRTLPPVNSNSVN

SEQ ID NO: 50545 - protein, 234 aa, Homo sapiens
  Payload ID: 10097
  Gene Symbol: MESDC2
  Gene Name: mesoderm development candidate 2
  Uniprot ID: Q14696
  ENSP ID: ENSP00000261758
MAASRWARKAVVLLCASDLLLLLLLLPPPGSCAAEGSPGTPDESTPPPRKKKKDIRDYNDADMARLLEQWEKDDDIEEGDLPEHKRPSAPVDFSKIDPSKPESILKMTKKGKTLMMFVTVSGSPTEKETEEITSLWQGSLFNANYDVQRFIVGSDRAIFMLRDGSYAWEIKDFLVGQDRCADVTLEGQVYPGKGGGSKEKNKTKQDKGKKKKEGDLKSRSSKEENRAGNKREDL

SEQ ID NO: 50546 - protein, 138 aa, Homo sapiens
  Payload ID: 10097
  Gene Symbol: MESDC2
  Gene Name: mesoderm development candidate 2
  Uniprot ID: Q14696
  ENSP ID: ENSP00000403839
MAASRWARKAVVLLCASDLLLLLLLLPPPGSCAAEGSPGTPDESTPPPRKKKKDIRDYNDADMARLLEQWETPEPLPVLPEVPSTCACLSSASLIWTCFSHLSPHALVKRVWPPAKQGLGGKESPASAWLPHRGGELK

SEQ ID NO: 50547 - protein, 80 aa, Homo sapiens
  Payload ID: 10097
  Gene Symbol: MESDC2
  Gene Name: mesoderm development candidate 2
  ENSP ID: ENSP00000453220
MAASRWARKAVVLLCASDLLLLLLLLPPPGSCAAEGSPGTPDESTPPPRKKKKDIRDYNDADMARLLEQWEANTCPTSTH

SEQ ID NO: 50548 - protein, 234 aa, Homo sapiens; identical to SEQ ID NO: 50545
  Payload ID: 10097
  Gene Symbol: MESDC2
  Gene Name: mesoderm development candidate 2
  Uniprot ID: Q14696
  ENSP ID: ENSP00000453430

SEQ ID NO: 50549 - protein, 234 aa, Homo sapiens; identical to SEQ ID NO: 50545
  Payload ID: 10097
  Gene Symbol: MESDC2
  Gene Name: mesoderm development candidate 2
  Uniprot ID: Q14696
  ENSP ID: ENSP00000482455

SEQ ID NO: 50550 - protein, 545 aa, Homo sapiens
  Payload ID: 10098
  Gene Symbol: MIER2
  Gene Name: mesoderm induction early response 1, family member 2
  Uniprot ID: Q8N344
  ENSP ID: ENSP00000264819
MAEASSLGRQSPRVVSCLEHSLCPGEPGLQTTAVVSMGSGDHQFNLAEILSQNYSVRGECEEASRCPDKPKEELEKDFISQSNDMPFDELLALYGYEASDPISDRESEGGDVAPNLPDMTLDKEQIAKDLLSGEEEEETQSSADDLTPSVTSHEASDLFPNRSGSRFLADEDREPGSSASSDTEEDSLPANKCKKEIMVGPQFQADLSNLHLNRHCEKIYENEDQLLWDPSVLPEREVEEFLYRAVKRRWHEMAGPQLPEGEAVKDSEQALYELVKCNFNVEEALRRLRFNVKVIRDGLCAWSEEECRNFEHGFRVHGKNFHLIQANKVRTRSVGECVEYYYLWKKSERYDYFAQQTRLGRRKYVPSGTTDADQDLDGSDPDGPGRPRPEQDTLTGMRTDPLSVDGTAGGLDEPGVASDGLPSSEPGPCSFQQLDESPAVPLSHRPPALADPASYQPAVTAPEPDASPRLAVDFALPKELPLISSHVDLSGDPEETVAPAQVALSVTEFGLIGIGDVNPFLAAHPTCPAPGLHSEPLSHCNVMTC

SEQ ID NO: 50551 - protein, 210 aa, Homo sapiens
  Payload ID: 10098
  Gene Symbol: MIER2
  Gene Name: mesoderm induction early response 1, family member 2
  ENSP ID: ENSP00000482489
  MOD_RES (1)..(1): Any amino acid
XRTRSVGECVEYYYLWKKSERYDYFAQQTRLGRRKDADQDLDGSDPDGPGRPRPEQDTLTGMRTDPLSVDGTAGGLDEPGVASDGLPSSEPGPCSFQQLDESPAVPLSHRPPALADPASYQPAVTAPEPDASPRLAVDFALPKELPLISSHVDLSGDPEETVAPAQVALSVTEFGLIGIGDVNPFLAAHPTCPAPGLHSEPLSHCNVMTC

SEQ ID NO: 50552 - protein, 145 aa, Homo sapiens
  Payload ID: 10099
  Gene Symbol: MIER3
  Gene Name: mesoderm induction early response 1, family member 3
  ENSP ID: ENSP00000337027
MLVHDYDDERTLEEEEMMDEGKNFSSEIEDLEKEGTMPLEDLLAFYGYEPTIPAVANSSANSSPSELADELPDMTLDKEEIAKDLLSGDDEETQSSADDLTPSVTSHETSDFFPRPLRSNTACDGDKESEVEDVETDSGNSPEDL

SEQ ID NO: 50553 - protein, 550 aa, Homo sapiens
  Payload ID: 10099
  Gene Symbol: MIER3
  Gene Name: mesoderm induction early response 1, family member 3
  Uniprot ID: Q7Z3K6
  ENSP ID: ENSP00000370596
MAEASFGSSSPVGSLSSEDHDFDPTAEMLVHDYDDERTLEEEEMMDEGKNFSSEIEDLEKEGTMPLEDLLAFYGYEPTIPAVANSSANSSPSELADELPDMTLDKEEIAKDLLSGDDEETQSSADDLTPSVTSHETSDFFPRPLRSNTACDGDKESEVEDVETDSGNSPEDLRKEIMIGLQYQAEIPPYLGEYDGNEKVYENEDQLLWCPDVVLESKVKEYLVETSLRTGSEKIMDRISAGTHTRDNEQALYELLKCNHNIKEAIERYCCNGKASQEGMTAWTEEECRSFEHALMLFGKDFHLIQKNKVRTRTVAECVAFYYMWKKSERYDYFAQQTRFGKKRYNHHPGVTDYMDRLVDETEALGGTVNASALTSNRPEPIPDQQLNILNSFTASDLTALTNSVATVCDPTDVNCLDDSFPPLGNTPRGQVNHVPVVTEELLTLPSNGESDCFNLFETGFYHSELNPMNMCSEESERPAKRLKMGIAVPESFMNEVSVNNLGVDFENHTHHITSAKMAVSVADFGSLSANETNGFISAHALHQHAALHSE

SEQ ID NO: 50554 - protein, 549 aa, Homo sapiens
  Payload ID: 10099
  Gene Symbol: MIER3
  Gene Name: mesoderm induction early response 1, family member 3
  Uniprot ID: Q7Z3K6
  ENSP ID: ENSP00000370611
MAEASFGSSSPVGSLSSEDHDFDPTAEMLVHDYDDERTLEEEEMMDEGKNFSSEIEDLEKEGTMPLEDLLAFYGYEPTIPAVANSSANSSPSELADELPDMTLDKEEIAKDLLSGDDEETQSSADDLTPSVTSHETSDFFPRPLRSNTACDGDKESEVEDVETDSGNSPEDLRKEIMIGLQYQAEIPPYLGEYDGNEKVYENEDQLLWCPDVVLESKVKEYLVETSLRTGSEKIMDRISAGTHTRDNEQALYELLKCNHNIKEAIERYCCNGKASQGMTAWTEEECRSFEHALMLFGKDFHLIQKNKVRTRTVAECVAFYYMWKKSERYDYFAQQTRFGKKRYNHHPGVTDYMDRLVDETEALGGTVNASALTSNRPEPIPDQQLNILNSFTASDLTALTNSVATVCDPTDVNCLDDSFPPLGNTPRGQVNHVPVVTEELLTLPSNGESDCFNLFETGFYHSELNPMNMCSEESERPAKRLKMGIAVPESFMNEVSVNNLGVDFENHTHHITSAKMAVSVADFGSLSANETNGFISAHALHQHAALHSE

SEQ ID NO: 50555 - protein, 555 aa, Homo sapiens
  Payload ID: 10099
  Gene Symbol: MIER3
  Gene Name: mesoderm induction early response 1, family member 3
  Uniprot ID: Q7Z3K6
  ENSP ID: ENSP00000370624
MAEASFGSSSPVCFIPVGSLSSEDHDFDPTAEMLVHDYDDERTLEEEEMMDEGKNFSSEIEDLEKEGTMPLEDLLAFYGYEPTIPAVANSSANSSPSELADELPDMTLDKEEIAKDLLSGDDEETQSSADDLTPSVTSHETSDFFPRPLRSNTACDGDKESEVEDVETDSGNSPEDLRKEIMIGLQYQAEIPPYLGEYDGNEKVYENEDQLLWCPDVVLESKVKEYLVETSLRTGSEKIMDRISAGTHTRDNEQALYELLKCNHNIKEAIERYCCNGKASQEGMTAWTEEECRSFEHALMLFGKDFHLIQKNKVRTRTVAECVAFYYMWKKSERYDYFAQQTRFGKKRYNHHPGVTDYMDRLVDETEALGGTVNASALTSNRPEPIPDQQLNILNSFTASDLTALTNSVATVCDPTDVNCLDDSFPPLGNTPRGQVNHVPVVTEELLTLPSNGESDCFNLFETGFYHSELNPMNMCSEESERPAKRLKMGIAVPESFMNEVSVNNLGVDFENHTHHITSAKMAVSVADFGSLSANETNGFISAHALHQHAALHSE

SEQ ID NO: 50556 - protein, 487 aa, Homo sapiens
  Payload ID: 10099
  Gene Symbol: MIER3
  Gene Name: mesoderm induction early response 1, family member 3
  Uniprot ID: Q7Z3K6
  ENSP ID: ENSP00000386584
MPLEDLLAFYGYEPTIPAVANSSANSSPSELADELPDMTLDKEEIAKDLLSGDDEETQSSADDLTPSVTSHETSDFFPRPLRSNTACDGDKESEVEDVETDSGNSPEDLRKEIMIGLQYQAEIPPYLGEYDGNEKVYENEDQLLWCPDVVLESKVKEYLVETSLRTGSEKIMDRISAGTHTRDNEQALYELLKCNHNIKEAIERYCCNGKASQEGMTAWTEEECRSFEHALMLFGKDFHLIQKNKVRTRTVAECVAFYYMWKKSERYDYFAQQTRFGKKRYNHHPGVTDYMDRLVDETEALGGTVNASALTSNRPEPIPDQQLNILNSFTASDLTALTNSVATVCDPTDVNCLDDSFPPLGNTPRGQVNHVPVVTEELLTLPSNGESDCFNLFETGFYHSELNPMNMCSEESERPAKRLKMGIAVPESFMNEVSVNNLGVDFENHTHHITSAKMAVSVADFGSLSANETNGFISAHALHQHAALHSE

SEQ ID NO: 50557 - protein, 44 aa, Homo sapiens
  Payload ID: 10099
  Gene Symbol: MIER3
  Gene Name: mesoderm induction early response 1, family member 3
  ENSP ID: ENSP00000400693
  MOD_RES (1)..(1): Any amino acid
XPTIPAVANSSANSSPSELADELPDMTLDKISGRERNPHLGTSS

SEQ ID NO: 50558 - protein, 24 aa, Homo sapiens
  Payload ID: 10099
  Gene Symbol: MIER3
  Gene Name: mesoderm induction early response 1, family member 3
  ENSP ID: ENSP00000407169
MEWRTEALASLGSLSSEDHDFDPT

SEQ ID NO: 50559 - protein, 119 aa, Homo sapiens
  Payload ID: 10099
  Gene Symbol: MIER3
  Gene Name: mesoderm induction early response 1, family member 3
  Uniprot ID: Q7Z3K6
  ENSP ID: ENSP00000408076
MAEASFGSSSPVGSLSSEDHDFDPTAEMLVHDYDDERTLEEEEMMDEGKNFSSEIEDLEKEGTMPLEDLLAFYGYEPTIPAVANSSANSSPSELADELPDMTLDKISGRERNPHLGTSS

SEQ ID NO: 50560 - protein, 512 aa, Homo sapiens
  Payload ID: 10100
  Gene Symbol: MIER1
  Gene Name: mesoderm induction early response 1, transcriptional regulator
  Uniprot ID: Q8N108
  ENSP ID: ENSP00000347514
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 50561 - protein, 370 aa, Homo sapiens
  Payload ID: 10100
  Gene Symbol: MIER1
  Gene Name: mesoderm induction early response 1, transcriptional regulator
  Uniprot ID: Q8N108
  ENSP ID: ENSP00000348253
MPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 50562 - protein, 529 aa, Homo sapiens
  Payload ID: 10100
  Gene Symbol: MIER1
  Gene Name: mesoderm induction early response 1, transcriptional regulator
  Uniprot ID: Q8N108
  ENSP ID: ENSP00000350321
MFMFNWFTDCLWTLFLSNYQPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 50563 - protein, 81 aa, Homo sapiens
  Payload ID: 10100
  Gene Symbol: MIER1
  Gene Name: mesoderm induction early response 1, transcriptional regulator
  Uniprot ID: Q8N108
  ENSP ID: ENSP00000360051
MFMFNWFTDCLWTLFLSNYQPSVESSSPGGSATSDDHEFDPSADMLVHDFDDERTLEEEEMMEGETNFSSEIEDLARVNNM

SEQ ID NO: 50564 - protein, 486 aa, Homo sapiens
  Payload ID: 10100
  Gene Symbol: MIER1
  Gene Name: mesoderm induction early response 1, transcriptional regulator
  Uniprot ID: Q8N108
  ENSP ID: ENSP00000360053
MDGASSGGGGSSEGGGGSSGSGYGVVARFSQCLAEFRTWLRTNWLRFNADKTDVMLPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 50565 - protein, 450 aa, Homo sapiens
  Payload ID: 10100
  Gene Symbol: MIER1
  Gene Name: mesoderm induction early response 1, transcriptional regulator
  Uniprot ID: Q8N108
  ENSP ID: ENSP00000360055
MFMFNWFTDCLWTLFLSNYQPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 50566 - protein, 470 aa, Homo sapiens
  Payload ID: 10100
  Gene Symbol: MIER1
  Gene Name: mesoderm induction early response 1, transcriptional regulator
  Uniprot ID: Q8N108
  ENSP ID: ENSP00000360057
MFMFNWFTDCLWTLFLSNYQPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGILQMLLPVHFSAISSRANAFLK

SEQ ID NO: 50567 - protein, 565 aa, Homo sapiens
  Payload ID: 10100
  Gene Symbol: MIER1
  Gene Name: mesoderm induction early response 1, transcriptional regulator
  Uniprot ID: Q8N108
  ENSP ID: ENSP00000383820
MDGASSGGGGSSEGGGGSSGSGYGVVARFSQCLAEFRTWLRTNWLRFNADKTDVMLPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 50568 - protein, 433 aa, Homo sapiens
  Payload ID: 10100
  Gene Symbol: MIER1
  Gene Name: mesoderm induction early response 1, transcriptional regulator
  Uniprot ID: Q8N108
  ENSP ID: ENSP00000383821
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 50569 - protein, 268 aa, Homo sapiens
  Payload ID: 10101
  Gene Symbol: MESP1
  Gene Name: mesoderm posterior bHLH transcription factor 1
  Uniprot ID: Q9BRJ9
  ENSP ID: ENSP00000300057
MAQPLCPPLSESWMLSAAWGPTRRPPPSDKDCGRSLVSSPDSWGSTPADSPVASPARPGTLRDPRAPSVGRRGARSSRLGSGQRQSASEREKLRMRTLARALHELRRFLPPSVAPAGQSLTKIETLRLAIRYIGHLSAVLGLSEESLQRRCRQRGDAGSPRGCPLCPDDCPAQMQTRTQAEGQGQGRGLGLVSAVRAGASWGSPPACPGARAAPEPRDPPALFAEAACPEGQAMEPSPPSPLLPGDVLALLETWMPLSPLEWLPEEPK

SEQ ID NO: 50570 - protein, 397 aa, Homo sapiens
  Payload ID: 10102
  Gene Symbol: MESP2
  Gene Name: mesoderm posterior bHLH transcription factor 2
  Uniprot ID: Q0VG99
  ENSP ID: ENSP00000342392
MAQSPPPQSLLGHDHWIFAQGWGWAGHWDSTSPASSSDSSGSCPCDGARGLPQPQPPSCSSRAAEAAATTPRRARTGPAGGQRQSASEREKLRMRTLARALHELRRFLPPSLAPAGQSLTKIETLRLAIRYIGHLSAVLGLSEESLQCRRRQRGDAGSPWGCPLCPDRGPAEAQTQAEGQGQGQGQGQGQGQGQGQGQGQGQGQGRRPGLVSAVLAEASWGSPSACPGAQAAPERLGRGVHDTDPWATPPYCPKIQSPPYSSQGTTSDASLWTPPQGCPWTQSSPEPRNPPVPWTAAPATLELAAVYQGLSVSPEPCLSLGAPSLLPHPSCQRLQPQTPGRCWSHSAEVVPNSEDQGPGAAFQLSEASPPQSSGLRFSGCPELWQEDLEGARLGIFY

SEQ ID NO: 50571 - protein, 99 aa, Homo sapiens
  Payload ID: 10102
  Gene Symbol: MESP2
  Gene Name: mesoderm posterior bHLH transcription factor 2
  ENSP ID: ENSP00000452998
MSHHARPNCMGLSVSPEPCLSLGAPSLLPHPSCQRLQPQTPGRCWSHSAEVVPNSEDQGPGAAFQLSEASPPQSSGLRFSGCPELWQEDLEGARLGIFY

SEQ ID NO: 50572 - protein, 335 aa, Homo sapiens
  Payload ID: 10103
  Gene Symbol: MEST
  Gene Name: mesoderm specific transcript
  Uniprot ID: Q5EB52
  ENSP ID: ENSP00000223215
MVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 50573 - protein, 326 aa, Homo sapiens
  Payload ID: 10103
  Gene Symbol: MEST
  Gene Name: mesoderm specific transcript
  Uniprot ID: Q5EB52
  ENSP ID: ENSP00000342749
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 50574 - protein, 292 aa, Homo sapiens
  Payload ID: 10103
  Gene Symbol: MEST
  Gene Name: mesoderm specific transcript
  Uniprot ID: Q5EB52
  ENSP ID: ENSP00000367839
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLLQYINQRKKFRRRWVGALASVTIPIHFIYGPLDPVNPYPEFLELYRKTLPRSTVSILDDHISHYPQLEDPMGFLNAYMGFINSF

SEQ ID NO: 50575 - protein, 326 aa, Homo sapiens; identical to SEQ ID NO: 50573
  Payload ID: 10103
  Gene Symbol: MEST
  Gene Name: mesoderm specific transcript
  Uniprot ID: Q5EB52
  ENSP ID: ENSP00000376884

SEQ ID NO: 50576 - protein, 117 aa, Homo sapiens
  Payload ID: 10103
  Gene Symbol: MEST
  Gene Name: mesoderm specific transcript
  ENSP ID: ENSP00000390589
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASI

SEQ ID NO: 50577 - protein, 126 aa, Homo sapiens
  Payload ID: 10103
  Gene Symbol: MEST
  Gene Name: mesoderm specific transcript
  ENSP ID: ENSP00000393709
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLG

SEQ ID NO: 50578 - protein, 169 aa, Homo sapiens
  Payload ID: 10103
  Gene Symbol: MEST
  Gene Name: mesoderm specific transcript
  ENSP ID: ENSP00000396504
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNG

SEQ ID NO: 50579 - protein, 296 aa, Homo sapiens
  Payload ID: 10103
  Gene Symbol: MEST
  Gene Name: mesoderm specific transcript
  ENSP ID: ENSP00000401657
MVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPRKRCRGPQCRFWMTTLATIHS

SEQ ID NO: 50580 - protein, 213 aa, Homo sapiens
  Payload ID: 10103
  Gene Symbol: MEST
  Gene Name: mesoderm specific transcript
  ENSP ID: ENSP00000407222
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFG

SEQ ID NO: 50581 - protein, 292 aa, Homo sapiens; identical to SEQ ID NO: 50574
  Payload ID: 10103
  Gene Symbol: MEST
  Gene Name: mesoderm specific transcript
  Uniprot ID: Q5EB52
  ENSP ID: ENSP00000408933

SEQ ID NO: 50582 - protein, 232 aa, Homo sapiens
  Payload ID: 10103
  Gene Symbol: MEST
  Gene Name: mesoderm specific transcript
  ENSP ID: ENSP00000409505
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLLQYINQRKKFRRRWVGALASVTIP

SEQ ID NO: 50583 - protein, 160 aa, Homo sapiens
  Payload ID: 10103
  Gene Symbol: MEST
  Gene Name: mesoderm specific transcript
  ENSP ID: ENSP00000409768
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLT

SEQ ID NO: 50584 - protein, 173 aa, Homo sapiens
  Payload ID: 10103
  Gene Symbol: MEST
  Gene Name: mesoderm specific transcript
  ENSP ID: ENSP00000473492
LLSHDYGDIVAQELLYRYKQNRSGRLTIKSLCLSNGGIFPETHRPLLLQKLLKDGGVLSPILTRLMNFFLWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 50585 - protein, 193 aa, Homo sapiens
  Payload ID: 10104
  Gene Symbol: MSGN1
  Gene Name: mesogenin 1
  Uniprot ID: A6NI15
  ENSP ID: ENSP00000281047
MDNLRETFLSLEDGLGSSDSPGLLSSWDWKDRAGPFELNQASPSQSLSPAPSLESYSSSPCPAVAGLPCEHGGASSGGSEGCSVGGASGLVEVDYNMLAFQPTHLQGGGGPKAQKGTKVRMSVQRRRKASEREKLRMRTLADALHTLRNYLPPVYSQRGQPLTKIQTLKYTIKYIGELTDLLNRGREPRAQSA

SEQ ID NO: 50586 - protein, 630 aa, Homo sapiens
  Payload ID: 10105
  Gene Symbol: MSLN
  Gene Name: mesothelin
  Uniprot ID: Q13421
  ENSP ID: ENSP00000372313
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 50587 - protein, 622 aa, Homo sapiens
  Payload ID: 10105
  Gene Symbol: MSLN
  Gene Name: mesothelin
  Uniprot ID: Q13421
  ENSP ID: ENSP00000442965
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 50588 - protein, 334 aa, Homo sapiens
  Payload ID: 10105
  Gene Symbol: MSLN
  Gene Name: mesothelin
  ENSP ID: ENSP00000454295
  MOD_RES (1)..(1): Any amino acid
XSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQGPGPVLTVLALLLASTLA

SEQ ID NO: 50589 - protein, 622 aa, Homo sapiens; identical to SEQ ID NO: 50587
  Payload ID: 10105
  Gene Symbol: MSLN
  Gene Name: mesothelin
  Uniprot ID: Q13421
  ENSP ID: ENSP00000456008

SEQ ID NO: 50590 - protein, 332 aa, Homo sapiens
  Payload ID: 10105
  Gene Symbol: MSLN
  Gene Name: mesothelin
  ENSP ID: ENSP00000456132
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNV

SEQ ID NO: 50591 - protein, 622 aa, Homo sapiens; identical to SEQ ID NO: 50587
  Payload ID: 10105
  Gene Symbol: MSLN
  Gene Name: mesothelin
  Uniprot ID: Q13421
  ENSP ID: ENSP00000456702

SEQ ID NO: 50592 - protein, 398 aa, Homo sapiens
  Payload ID: 10105
  Gene Symbol: MSLN
  Gene Name: mesothelin
  ENSP ID: ENSP00000457847
VEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQGGRGGQARAGGRAGGVEVGALSHPSLCRGPLGDALPPRTWTCSHRPGTAPSLHPGLRAPLPCWPQPCWGSPPGQEQARVVPVPPQENSRSVNGNMPPADT

SEQ ID NO: 50593 - protein, 170 aa, Homo sapiens
  Payload ID: 10105
  Gene Symbol: MSLN
  Gene Name: mesothelin
  ENSP ID: ENSP00000458003
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACW

SEQ ID NO: 50594 - protein, 630 aa, Homo sapiens; identical to SEQ ID NO: 50586
  Payload ID: 10105
  Gene Symbol: MSLN
  Gene Name: mesothelin
  Uniprot ID: Q13421
  ENSP ID: ENSP00000482893

SEQ ID NO: 50595 - protein, 702 aa, Homo sapiens
  Payload ID: 10106
  Gene Symbol: MSLNL
  Gene Name: mesothelin-like
  Uniprot ID: Q96KJ4
  ENSP ID: ENSP00000415767
MAAAVTIPGPRIGALQSSGLTLLLSLAAHCSGPQAKVLSPGGLDASGANLWASANCSLLQGFWCQPASQLPRDQLSALIQRLALLQVPLQAWQLSCLANLASRCGLQDDFTLHPPNLLLFYNLSQVREADCRAFIRRAAQGDVELLSHLPDQRVALWRAAVACLVGAGLRLSASDQQLLGALVCDMDASSIGAADPHMLENLRRCPRLTAAQRIALNSLLAGGKTSLGPPGSWTLEGLQALGPLATYISPHLWAQVQEAVGLGFFRSVVASCQVGRLGQREARCFVTSFLESKTKPVSSRPRLSTGNITAATLRDDLFLVHYDCAELESCLDGCILRTNLDTLLQHLLPTECQHVVKAKLAQIYPQGLPEDQLRLITSLVYLYSRTEIGQWSITSQDTVMALLASDVALENQTEAVLQKFLEHNGTVSGALLLAIGGTRLCWMSPHQIQTIHPQELRLAGALDLSSCPQSRKDVLYTKAHETFGSSGTLAAYYRLMRPYLGGSPGGAQPPSPVPPGGAPVEELRHLAHANISMDIDTFTSLNPLELQSLDVGNVTALLGHNVGDLQKARSHPTVRAWLRSLNSSTLGQLGLDASPTSPTGPAHGTRGPPSTTHQVLHLVHTSGLPTNDAQASTSGSLWAPLGYLPLAMALPCSLLCLLHWGTCILVSVDSVASGWLGSQGSGAGKTEVLDSAGRPLGLTGQL

SEQ ID NO: 50596 - protein, 752 aa, Homo sapiens
  Payload ID: 10106
  Gene Symbol: MSLNL
  Gene Name: mesothelin-like
  ENSP ID: ENSP00000441381
SWTHCPWPQHLPALGRLSQDDQCTPPHRRGPQSGCPAELRPHPPAVPCCPLLWAPGQGSFPRRAGCQRGQPVGQCQLLPAARLLVPAGQPAAPGPALSPNPEAGLAAGPPPGLAGEREGVCLANLASRCGLQDDFTLHPPNLLLFYNLSQVREADCRAFIRRAAQGDVELLSHLPDQRVALWRAAVACLVGAGWGWARCIGGSLPLGADLLALQGVARLRLSASDQQLLGALVCDMDASSIGAADPHMLENLRRCPRLTAAQRIALNSLLAGGKTSLGPPGSWTLEGLQALGPLATYISPHLWAQVQEAVGLGFFRSVVASCQVGRLGQREARCFVTSFLESKTKPVSSRPRLSTGNITAATLRDDLFLVHYDCAELESCLDGCILRTNLDTLLQHLLPTECQHVVKAKLAQIYPQGLPEDQLRLITSLVYLYSRTEIGQWSITSQDTVMALLASDVALENQTEAVLQKFLEHNGTVSGALLLAIGGTRLCWMSPHQIQTIHPQELRLAGALDLSSCPQSRKDVLYTKAHETFGSSGTLAAYYRLMRPYLGGSPGGAQPPSPVPPGGAPVEELRHLAHANISMDIDTFTSLNPLELQSLDVGNVTALLGHNVGDLQKARSHPTVRAWLRSLNSSTLGQLGLDASPTSPTGPAHGTRGPPSTTHQVLHLVHTSGLPTNDAQASTSGSLWAPLGYLPLAMALPCSLLCLLHWGTCILVSVDSVASGWLGSQGSGAGKTEVLDSAGRPLGLTGQL

SEQ ID NO: 50597 - protein, 1408 aa, Homo sapiens
  Payload ID: 10107
  Gene Symbol: MET
  Gene Name: MET proto-oncogene, receptor tyrosine kinase
  Uniprot ID: P08581
  ENSP ID: ENSP00000317272
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 50598 - protein, 1390 aa, Homo sapiens
  Payload ID: 10107
  Gene Symbol: MET
  Gene Name: MET proto-oncogene, receptor tyrosine kinase
  Uniprot ID: P08581
  ENSP ID: ENSP00000380860
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 50599 - protein, 158 aa, Homo sapiens
  Payload ID: 10107
  Gene Symbol: MET
  Gene Name: MET proto-oncogene, receptor tyrosine kinase
  ENSP ID: ENSP00000398140
AVKGEVLKVGNKSCENIHLHSEAVLCTVPNDLLKLNSELNIEWKQAISSTVLGKVIVQPDQNFTGLIAGVVSISTALLLLLGFFLWLKKRKQIKDQFPNSSQNGSCRQVQYPLTDMSPILTSGDSDISSPLLQNTVHIDLSALNPELVQAVQHVVIGP

SEQ ID NO: 50600 - protein, 214 aa, Homo sapiens
  Payload ID: 10107
  Gene Symbol: MET
  Gene Name: MET proto-oncogene, receptor tyrosine kinase
  ENSP ID: ENSP00000398776
AVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEVGFLHSSHDVNKEASVIMLFSGLK

SEQ ID NO: 50601 - protein, 764 aa, Homo sapiens
  Payload ID: 10107
  Gene Symbol: MET
  Gene Name: MET proto-oncogene, receptor tyrosine kinase
  Uniprot ID: P08581
  ENSP ID: ENSP00000410980
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFIRHVNIALIQR

SEQ ID NO: 50602 - protein, 190 aa, Homo sapiens
  Payload ID: 10107
  Gene Symbol: MET
  Gene Name: MET proto-oncogene, receptor tyrosine kinase
  ENSP ID: ENSP00000413857
MKSKSKSLAECFPYDKPLIMKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQ

SEQ ID NO: 50603 - protein, 582 aa, Homo sapiens
  Payload ID: 10108
  Gene Symbol: MTDH
  Gene Name: metadherin
  Uniprot ID: Q86UE4
  ENSP ID: ENSP00000338235
MAARSWQDELAQQAEEGSARLREMLSVGLGFLRTELGLDLGLEPKRYPGWVILVGTGALGLLLLFLLGYGWAAACAGARKKRRSPPRKREEAAAVPAAAPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 50604 - protein, 526 aa, Homo sapiens
  Payload ID: 10108
  Gene Symbol: MTDH
  Gene Name: metadherin
  ENSP ID: ENSP00000428168
MLSVGLGFLRTELGLDLGLEPKRYPGWVILVGTGALGLLLLFLLGYGWAAACAGARKKRRSPPRKREEAAAVPAAAPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIDGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 50605 - protein, 224 aa, Homo sapiens
  Payload ID: 10108
  Gene Symbol: MTDH
  Gene Name: metadherin
  ENSP ID: ENSP00000428703
  MOD_RES (1)..(1): Any amino acid
XAAAPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKVSSGLNENLTVNGGGWNEKSVKLSSQISAGEEKWNSVSPASAGKRKTEPSAWSQDTGDANTNGKDWGRSWS

SEQ ID NO: 50606 - protein, 60 aa, Homo sapiens
  Payload ID: 10108
  Gene Symbol: MTDH
  Gene Name: metadherin
  ENSP ID: ENSP00000429289
  MOD_RES (1)..(1): Any amino acid
XSSQISAGEEKWNSVSPASAGKRKTEPSAWSQDTGDANTNGKDWGRSWSDRSIFSGIGLR

SEQ ID NO: 50607 - protein, 188 aa, Homo sapiens
  Payload ID: 10108
  Gene Symbol: MTDH
  Gene Name: metadherin
  ENSP ID: ENSP00000429642
TNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSDDDKEKGEGALPTGKSKKKKKKKKKQGEDNSTAQPIKTLPPATSTEPSVILSKSDSDKSSSQVPPILQETDKSKSNTKQNSVPPSQTKSETS

SEQ ID NO: 50608 - protein, 593 aa, Homo sapiens
  Payload ID: 10109
  Gene Symbol: MTF2
  Gene Name: metal response element binding transcription factor 2
  Uniprot ID: Q9Y483
  ENSP ID: ENSP00000359321
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 50609 - protein, 536 aa, Homo sapiens
  Payload ID: 10109
  Gene Symbol: MTF2
  Gene Name: metal response element binding transcription factor 2
  ENSP ID: ENSP00000359326
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMEVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 50610 - protein, 491 aa, Homo sapiens
  Payload ID: 10109
  Gene Symbol: MTF2
  Gene Name: metal response element binding transcription factor 2
  ENSP ID: ENSP00000443295
MVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 50611 - protein, 491 aa, Homo sapiens; identical to SEQ ID NO: 50610
  Payload ID: 10109
  Gene Symbol: MTF2
  Gene Name: metal response element binding transcription factor 2
  ENSP ID: ENSP00000444962

SEQ ID NO: 50612 - protein, 266 aa, Homo sapiens
  Payload ID: 10110
  Gene Symbol: MBLAC1
  Gene Name: metallo-beta-lactamase domain containing 1
  Uniprot ID: A4D2B0
  ENSP ID: ENSP00000381150
MRTEPLCGASPLLVPGDPYSVVVLLQGYAEPEGVGDAVRADGSVTLVLPQTRGPASSHRESPRGSGGAEAALEEAARGPILVDTGGPWAREALLGALAGQGVAPGDVTLVVGTHGHSDHIGNLGLFPGAALLVSHDFCLPGGRYLPHGLGEGQPLRLGPGLEVWATPGHGGQRDVSVVVAGTALGTVVVAGDVFERDGDEDSWQALSEDPAAQERSRKRVLVVADVVVPGHGPPFRVLREASQPETEGGGNSQQEPVVGDEEPALH

SEQ ID NO: 50613 - protein, 113 aa, Homo sapiens
  Payload ID: 10110
  Gene Symbol: MBLAC1
  Gene Name: metallo-beta-lactamase domain containing 1
  ENSP ID: ENSP00000406055
MRTEPLCGASPLLVPGDPYSVVVLLQGYAEPEGVGDAVRADGSVTLVLPQTRGPASSHRESPRGSGGAEAALEEAARGPILVDTGGPWAREALLGALAGQGVAPGDVTLVVGT

SEQ ID NO: 50614 - protein, 279 aa, Homo sapiens
  Payload ID: 10111
  Gene Symbol: MBLAC2
  Gene Name: metallo-beta-lactamase domain containing 2
  Uniprot ID: Q68D91
  ENSP ID: ENSP00000314776
MSALEWYAHKSLGDGIFWIQERFYESGNRANIWLVRGSEQDVVIDTGLGLRSLPEYLYSSGLLQDREAKEDAARRPLLAVATHVHFDHSGGLYQFDRVAVHHAEAEALARGDNFETVTWLSDSEVVRTPSPGWRARQFRVQAVQPTLILQDGDVINLGDRQLTVMHMPGHSRGSICLHDKDRKILFSGDVVYDGSLIDWLPYSRISDYVGTCERLIELVDRGLVEKVLPGHFNTFGAERLFRLASNYISKAGICHKVSTFAMRSLASLALRVTNSRTSP

SEQ ID NO: 50615 - protein, 199 aa, Homo sapiens
  Payload ID: 10111
  Gene Symbol: MBLAC2
  Gene Name: metallo-beta-lactamase domain containing 2
  Uniprot ID: Q68D91
  ENSP ID: ENSP00000425600
MSALEWYAHKSLGDGIFWIQERFYESGNRANIWLVRGSEQDVVIDTGLGLRSLPEYLYSSGLLQDREAKEDAARRPLLAVATHVHFDHSGGLYQFDRVAVHHAEAEALARGDNFETVTWLSDSEVVRTPSPGWRARQFRVQAVQPTLILQDGNGPPRARALVKGGYWEETVRVPHVADLRGHKGDYFGTSQSHFCFTLP

SEQ ID NO: 50616 - protein, 333 aa, Homo sapiens
  Payload ID: 10112
  Gene Symbol: MPPE1
  Gene Name: metallophosphoesterase 1
  Uniprot ID: Q53F39
  ENSP ID: ENSP00000311200
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSRELLWWLQPRLVLSGHTHSACEVHHGGRVPELSVPSFSWRNRNNPSFIMGSITPTDYTLSKCYLPREDVVLIIYCGVVGFLVVLTLTHFGLLASPFLSGLNLLGKRKTR

SEQ ID NO: 50617 - protein, 243 aa, Homo sapiens
  Payload ID: 10112
  Gene Symbol: MPPE1
  Gene Name: metallophosphoesterase 1
  ENSP ID: ENSP00000312935
MERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREARGSSRCGPGPLLPTSAPVLLQHYPLYRRSDANCSGEDAAPAEERDIPFKENYDVLSREASQKLLWWLQPRLVLSGHTHSACEVHHGGRVPELSVPSFSWRNRNNPSFIMGTDA

SEQ ID NO: 50618 - protein, 333 aa, Homo sapiens; identical to SEQ ID NO: 50616
  Payload ID: 10112
  Gene Symbol: MPPE1
  Gene Name: metallophosphoesterase 1
  Uniprot ID: Q53F39
  ENSP ID: ENSP00000327257

SEQ ID NO: 50619 - protein, 374 aa, Homo sapiens
  Payload ID: 10112
  Gene Symbol: MPPE1
  Gene Name: metallophosphoesterase 1
  ENSP ID: ENSP00000339423
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREHYPLYRRSDANCSGEDAAPAEERDIPFKENYDVLSREASQKLLWWLQPRLVLSGHTHSACEVHHGGRVPELSVPSFSWRNRNNPSFIMGSITPTDYTLSKCYLPREDVVLIIYCGVVGFLVVLTLTHFGLLASPFLSGLNLLGKRKTR

SEQ ID NO: 50620 - protein, 340 aa, Homo sapiens
  Payload ID: 10112
  Gene Symbol: MPPE1
  Gene Name: metallophosphoesterase 1
  Uniprot ID: Q53F39
  ENSP ID: ENSP00000433950
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREARGSSRCGPGPLLPTSAPVLLQHYPLYRRSDANCSGEDAAPAEERDIPFKENYDVLSREASQKLLWWLQPRLVLSGHTHSACEVHHGGRVPELSVPSFSWRNRNNPSFIMGTDA

SEQ ID NO: 50621 - protein, 81 aa, Homo sapiens
  Payload ID: 10112
  Gene Symbol: MPPE1
  Gene Name: metallophosphoesterase 1
  ENSP ID: ENSP00000464842
LTCTQQARGSSRCGPGPLLPTSAPVLLQHYPLYRRSDANCSGEDAAPAEERDIPFKENYDVLSREASQKERSDGQRPSAER

SEQ ID NO: 50622 - protein, 141 aa, Homo sapiens
  Payload ID: 10112
  Gene Symbol: MPPE1
  Gene Name: metallophosphoesterase 1
  ENSP ID: ENSP00000465318
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQK

SEQ ID NO: 50623 - protein, 396 aa, Homo sapiens
  Payload ID: 10112
  Gene Symbol: MPPE1
  Gene Name: metallophosphoesterase 1
  Uniprot ID: Q53F39
  ENSP ID: ENSP00000465894
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREARGSSRCGPGPLLPTSAPVLLQHYPLYRRSDANCSGEDAAPAEERDIPFKENYDVLSREASQKLLWWLQPRLVLSGHTHSACEVHHGGRVPELSVPSFSWRNRNNPSFIMGSITPTDYTLSKCYLPREDVVLIIYCGVVGFLVVLTLTHFGLLASPFLSGLNLLGKRKTR

SEQ ID NO: 50624 - protein, 161 aa, Homo sapiens
  Payload ID: 10112
  Gene Symbol: MPPE1
  Gene Name: metallophosphoesterase 1
  ENSP ID: ENSP00000466291
GNHDIGFHYDFVMVNSVALNGDGCGICSETEAELIEVSHRLNCSREQARGSSRCGPGPLLPTSAPVLLQHYPLYRRSDANCSGEDAAPAEERDIPFKENYDVLSREASQKLLWWLQPRLVLSGHTHSACEVHHGGRVPELSVPSFSWRNRNNPSFIMGTDA

SEQ ID NO: 50625 - protein, 172 aa, Homo sapiens
  Payload ID: 10112
  Gene Symbol: MPPE1
  Gene Name: metallophosphoesterase 1
  ENSP ID: ENSP00000466303
MLVLNSWPQVILPPWPPKALKLQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREQARGSSRCGPGPLLPTSAPV

SEQ ID NO: 50626 - protein, 26 aa, Homo sapiens
  Payload ID: 10112
  Gene Symbol: MPPE1
  Gene Name: metallophosphoesterase 1
  ENSP ID: ENSP00000467599
MAMIELGFGRQNFHPLKRKSSLLLKL

SEQ ID NO: 50627 - protein, 164 aa, Homo sapiens
  Payload ID: 10112
  Gene Symbol: MPPE1
  Gene Name: metallophosphoesterase 1
  ENSP ID: ENSP00000467698
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHY

SEQ ID NO: 50628 - protein, 69 aa, Homo sapiens
  Payload ID: 10112
  Gene Symbol: MPPE1
  Gene Name: metallophosphoesterase 1
  ENSP ID: ENSP00000467703
MAMIELGFGRQNFHPLKRKSSLLLKLIAVVFAVLLFCEFLIYYLAIFQCNWPEVKTTASDGEQTTREPV

SEQ ID NO: 50629 - protein, 178 aa, Homo sapiens
  Payload ID: 10112
  Gene Symbol: MPPE1
  Gene Name: metallophosphoesterase 1
  ENSP ID: ENSP00000467993
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVF

SEQ ID NO: 50630 - protein, 92 aa, Homo sapiens
  Payload ID: 10112
  Gene Symbol: MPPE1
  Gene Name: metallophosphoesterase 1
  ENSP ID: ENSP00000468065
MAMIELGFGRQNFHPLKRKSSLLLKLIAVVFAVLLFCEFLIYYLAIFQCNWPEVKTTASDGEQTTREPVLKAMFLADTHLLGEFLGHWLDKL

SEQ ID NO: 50631 - protein, 68 aa, Homo sapiens
  Payload ID: 10112
  Gene Symbol: MPPE1
  Gene Name: metallophosphoesterase 1
  ENSP ID: ENSP00000468269
MAMIELGFGRQNFHPLKRKSSLLLKLIAVVFAVLLFCEFLIYYLAIFQCNWPEVKTTASDGEQTTREP

SEQ ID NO: 50632 - protein, 308 aa, Homo sapiens
  Payload ID: 10112
  Gene Symbol: MPPE1
  Gene Name: metallophosphoesterase 1
  ENSP ID: ENSP00000468606
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREARGSSRCGPGPLLPTSAPVLLQHYPLYRRSDANCSGEDAAPAEERDIPFKENYDVLSREASQKLLWWLQPRLVLSGHTHSAC

SEQ ID NO: 50633 - protein, 94 aa, Homo sapiens
  Payload ID: 10112
  Gene Symbol: MPPE1
  Gene Name: metallophosphoesterase 1
  ENSP ID: ENSP00000468639
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRR

SEQ ID NO: 50634 - protein, 119 aa, Homo sapiens
  Payload ID: 10113
  Gene Symbol: MPPED1
  Gene Name: metallophosphoesterase domain containing 1
  ENSP ID: ENSP00000335568
MWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDF

SEQ ID NO: 50635 - protein, 326 aa, Homo sapiens
  Payload ID: 10113
  Gene Symbol: MPPED1
  Gene Name: metallophosphoesterase domain containing 1
  Uniprot ID: O15442
  ENSP ID: ENSP00000388137
MWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRNS

SEQ ID NO: 50636 - protein, 326 aa, Homo sapiens; identical to SEQ ID NO: 50635
  Payload ID: 10113
  Gene Symbol: MPPED1
  Gene Name: metallophosphoesterase domain containing 1
  Uniprot ID: O15442
  ENSP ID: ENSP00000400686

SEQ ID NO: 50637 - protein, 74 aa, Homo sapiens
  Payload ID: 10113
  Gene Symbol: MPPED1
  Gene Name: metallophosphoesterase domain containing 1
  ENSP ID: ENSP00000401378
MWRSRWDASVLKAEALALLPCGLGMAFSQSHVMAARRHQHSRLIIEVDEYSSNPTQAFTFYNINQGRFQPPHVQ

SEQ ID NO: 50638 - protein, 294 aa, Homo sapiens
  Payload ID: 10114
  Gene Symbol: MPPED2
  Gene Name: metallophosphoesterase domain containing 2
  Uniprot ID: Q15777
  ENSP ID: ENSP00000350833
MAHGIPSQGKVTITVDEYSSNPTQAFTHYNINQSRFQPPHVHMVDPIPYDTPKPAGHTRFVCISDTHSRTDGIQMPYGDILLHTGDFTELGLPSEVKKFNDWLGNLPYEYKIVIAGNHELTFDKEFMADLVKQDYYRFPSVSKLKPEDFDNVQSLLTNSIYLQDSEVTVKGFRIYGAPWTPWFNGWGFNLPRGQSLLDKWNLIPEGIDILMTHGPPLGFRDWVPKELQRVGCVELLNTVQRRVRPKLHVFGGIHEGYGIMTDGYTTYINASTCTVSFQPTNPPIIFDLPNPQGS

SEQ ID NO: 50639 - protein, 277 aa, Homo sapiens
  Payload ID: 10114
  Gene Symbol: MPPED2
  Gene Name: metallophosphoesterase domain containing 2
  Uniprot ID: Q15777
  ENSP ID: ENSP00000388258
MAHGIPSQGKVTITVDEYSSNPTQAFTHYNINQSRFQPPHVHMVDPIPYDTPKPAGHTRFVCISDTHSRTDGIQMPYGDILLHTGDFTELGLPSEVKKFNDWLGNLPYEYKIVIAGNHELTFDKEFMADLVKQDYYRFPSVSKLKPEDFDNVQSLLTNSIYLQDSEVTVKGFRIYGAPWTPWFNGWGFNLPRGQSLLDKWNLIPEGIDILMTHGPPLGFRDWVPKELQRVGCVELLNTVQRRVRPKLHVFGGIHEVNPVSISKALRTKICSLPSKTS

SEQ ID NO: 50640 - protein, 81 aa, Homo sapiens
  Payload ID: 10114
  Gene Symbol: MPPED2
  Gene Name: metallophosphoesterase domain containing 2
  ENSP ID: ENSP00000431805
MAHGIPSQGKVTITVDEYSSNPTQAFTHYNINQSRFQPPHVHMVDPIPYDTPKPAGHTRFVCISDTHSRTDGIQMPYGDIL

SEQ ID NO: 50641 - protein, 117 aa, Homo sapiens
  Payload ID: 10114
  Gene Symbol: MPPED2
  Gene Name: metallophosphoesterase domain containing 2
  ENSP ID: ENSP00000432469
MAHGIPSQGKVTITVDEYSSNPTQAFTHYNINQSRFQPPHVHMVDPIPYDTPKPAGHTRFVCISDTHSRTDGIQMPYGDILLHTGDFTELGLPSEVKKFNDWLDLVSHCKHGRNPNA

SEQ ID NO: 50642 - protein, 61 aa, Homo sapiens
  Payload ID: 10115
  Gene Symbol: MT1A
  Gene Name: metallothionein 1A
  Uniprot ID: P04731
  ENSP ID: ENSP00000290705
MDPNCSCATGGSCTCTGSCKCKECKCTSCKKSCCSCCPMSCAKCAQGCICKGASEKCSCCA

SEQ ID NO: 50643 - protein, 61 aa, Homo sapiens; identical to SEQ ID NO: 50642
  Payload ID: 10115
  Gene Symbol: MT1A
  Gene Name: metallothionein 1A
  Uniprot ID: P04731
  ENSP ID: ENSP00000478425

SEQ ID NO: 50644 - protein, 61 aa, Homo sapiens
  Payload ID: 10116
  Gene Symbol: MT1B
  Gene Name: metallothionein 1B
  Uniprot ID: P07438
  ENSP ID: ENSP00000334998
MDPNCSCTTGGSCACAGSCKCKECKCTSCKKCCCSCCPVGCAKCAQGCVCKGSSEKCRCCA

SEQ ID NO: 50645 - protein, 70 aa, Homo sapiens
  Payload ID: 10116
  Gene Symbol: MT1B
  Gene Name: metallothionein 1B
  ENSP ID: ENSP00000456056
MDPNCSCTTGGSCACAGSCKCKECKCTSCKKLLLLLPRGLCQVCPGLCLQRLIREVPLLCLMLGEPCSQT

SEQ ID NO: 50646 - protein, 61 aa, Homo sapiens
  Payload ID: 10117
  Gene Symbol: MT1E
  Gene Name: metallothionein 1E
  Uniprot ID: P04732
  ENSP ID: ENSP00000307706
MDPNCSCATGGSCTCAGSCKCKECKCTSCKKSCCSCCPVGCAKCAQGCVCKGASEKCSCCA

SEQ ID NO: 50647 - protein, 127 aa, Homo sapiens
  Payload ID: 10117
  Gene Symbol: MT1E
  Gene Name: metallothionein 1E
  Uniprot ID: P04732
  ENSP ID: ENSP00000328137
MDPNCSCATGGSCTCAGSCKCKECKCTSCKKSECGAISRNLGLWLRLGGNSRLALSASFWGTGLSLPSLPVSFPLQAFCPKFRWGRTAFFSWDTNPNCTPYGFRTELCQTKKSILWVWVLSSSQACY

SEQ ID NO: 50648 - protein, 39 aa, Homo sapiens
  Payload ID: 10117
  Gene Symbol: MT1E
  Gene Name: metallothionein 1E
  ENSP ID: ENSP00000457516
MDPNCSCATGCCSCCPVGCAKCAQGCVCKGASEKCSCCA

SEQ ID NO: 50649 - protein, 61 aa, Homo sapiens
  Payload ID: 10118
  Gene Symbol: MT1F
  Gene Name: metallothionein 1F
  Uniprot ID: P04733
  ENSP ID: ENSP00000334872
MDPNCSCAAGVSCTCAGSCKCKECKCTSCKKSCCSCCPVGCSKCAQGCVCKGASEKCSCCD

SEQ ID NO: 50650 - protein, 44 aa, Homo sapiens
  Payload ID: 10118
  Gene Symbol: MT1F
  Gene Name: metallothionein 1F
  ENSP ID: ENSP00000456462
MDPNCSCAAGVSCTCAGSCKCKECKCTSCKKSECEAISMVWGCG

SEQ ID NO: 50651 - protein, 62 aa, Homo sapiens
  Payload ID: 10119
  Gene Symbol: MT1G
  Gene Name: metallothionein 1G
  Uniprot ID: P13640
  ENSP ID: ENSP00000369139
MDPNCSCAAAGVSCTCASSCKCKECKCTSCKKSCCSCCPVGCAKCAQGCICKGASEKCSCCA

SEQ ID NO: 50652 - protein, 61 aa, Homo sapiens
  Payload ID: 10119
  Gene Symbol: MT1G
  Gene Name: metallothionein 1G
  Uniprot ID: P13640
  ENSP ID: ENSP00000391397
MDPNCSCAAGVSCTCASSCKCKECKCTSCKKSCCSCCPVGCAKCAQGCICKGASEKCSCCA

SEQ ID NO: 50653 - protein, 39 aa, Homo sapiens
  Payload ID: 10119
  Gene Symbol: MT1G
  Gene Name: metallothionein 1G
  ENSP ID: ENSP00000456675
MDPNCSCAAGCCSCCPVGCAKCAQGCICKGASEKCSCCA

SEQ ID NO: 50654 - protein, 68 aa, Homo sapiens
  Payload ID: 10119
  Gene Symbol: MT1G
  Gene Name: metallothionein 1G
  ENSP ID: ENSP00000456835
MDPNCSCAAGVSCTCASSCKCKECKCTSCKKSECGAISRNLGLWLRLGGNPRLSLSACFWGTGLPLSL

SEQ ID NO: 50655 - protein, 61 aa, Homo sapiens
  Payload ID: 10120
  Gene Symbol: MT1H
  Gene Name: metallothionein 1H
  Uniprot ID: P80294
  ENSP ID: ENSP00000330587
MDPNCSCEAGGSCACAGSCKCKKCKCTSCKKSCCSCCPLGCAKCAQGCICKGASEKCSCCA

SEQ ID NO: 50656 - protein, 85 aa, Homo sapiens
  Payload ID: 10120
  Gene Symbol: MT1H
  Gene Name: metallothionein 1H
  ENSP ID: ENSP00000457114
MDPNCSCEAGGSCACAGSCKCKKCKCTSCKKSECGAISRNLGLWLRLGGNPRLALSACFLCPPRPSLPFQSSALSRAPVGLGSLS

SEQ ID NO: 50657 - protein, 61 aa, Homo sapiens
  Payload ID: 10121
  Gene Symbol: MT1HL1
  Gene Name: metallothionein 1H-like 1
  Uniprot ID: P0DM35
  ENSP ID: ENSP00000476141
MDPNCSCAAGGSYACAGSCKCKKCKCTSCKKSCCSCCPLGCAKCAQGCIRKGASEKCSCCA

SEQ ID NO: 50658 - protein, 61 aa, Homo sapiens
  Payload ID: 10122
  Gene Symbol: MT1M
  Gene Name: metallothionein 1M
  Uniprot ID: Q8N339
  ENSP ID: ENSP00000369146
MDPNCSCTTGVSCACTGSCTCKECKCTSCKKSCCSCCPVGCAKCAHGCVCKGTLENCSCCA
